United States Patent 11,098,302 (IDENTIFICATION OF POLYNUCLEOTIDES ASSOCIATED WITH A SAMPLE) - sequence listing, part 122

SEQ ID NO: 422862 - DNA, 636 bp, Homo sapiens
  misc_feature: GZ8MTXP02IO9CH.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagacgccggcctccatctcctgcaggtctagtcagacgcctccagcatactgatggataacaacttattggattggtacctgacaagaacgccgagggcagtcctaccaacaacctcctgacttcgttagttttcgggtactaacgtccggggtccgtccccggggtccctgacgtaggttcaggttggctaggtgactcgagactataagttaatttaacactagaaaatcgaagacgaagtaggtaggggagtacgtagggtaagggtacgggttttaggggttttaaacttacgtgactagtacgacgtaaacggttacctaaaccgaaaccccgtagtaccgtaaccgttacgggaccggaaacgggaccaccgggtaccgtaaggaaacgtaaacttaaaacggtaacgtggtacggtcacgactaaccctattccg

SEQ ID NO: 422863 - DNA, 598 bp, Homo sapiens
  misc_feature: GZ8MTXP02ILHV6.15.25.C03.1.454.CMB.2.raw
  modified_base (252)..(252): a, c, t, g, unknown or other
  modified_base (257)..(257): a, c, t, g, unknown or other
  modified_base (267)..(267): a, c, t, g, unknown or other
  modified_base (283)..(283): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtccaccctggagagccggcctccatctcctgcaggtctagtcagacgcctcagcatactgatggatanaactnttgattgacngcagagcaggcagtcncacactctagatcttagtttggtctaacgtcgggacctccggggtcccctgacgtacgttcgagtcggcagggtgatcgaggactagtacgttactttaacagtaagaaaactcgaagtacgaaggaggtagggacggacgtgggaacgggttacgggtttaggggtttaagttagttacggatagttacggacgtaaacgggtacctaaaccgaaacccggtataccgtaccgttcggaccggacggacgaccgaccgttaggacgtaaacgtaaacgaacgttgacgggacctagacctacctacgtcttacg

SEQ ID NO: 422864 - DNA, 615 bp, Homo sapiens
  misc_feature: GZ8MTXP02HTXRY.15.25.C03.1.454.CMB.2.raw
  modified_base (257)..(257): a, c, t, g, unknown or other
  modified_base (267)..(267): a, c, t, g, unknown or other
  modified_base (308)..(308): a, c, t, g, unknown or other
  modified_base (449)..(449): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcaccctggagacgccgcctccatctcctgcaggtctagtcagacgcctccagcatactgatggatacatnttgatgtacngacagaacgccgaggcacgtctaccaactaactctgacttnttagtttcggtactaacgtccggggtcccgtccggggtacccctggacgtaggttcgaggtcggactagggtggaactcgaggtacctagtaaagtttatttaccaagttaagaaaactcagacaggtacggtggagtcgngtacggtaggtttgggtttaactacgtgactagtagaccgtaaggtacctaaccgaaaccctagtacctacggttacccggacggaaacggtacacccggcgttaagggaacgtaaaccgtttaaaacggcgttaacggtcgtacgtacacgtactactttcgtcg

SEQ ID NO: 422865 - DNA, 570 bp, Homo sapiens
  misc_feature: GZ8MTXP02HVXHL.15.25.C03.1.454.CMB.2.raw
  modified_base (340)..(340): a, c, t, g, unknown or other
  modified_base (355)..(355): a, c, t, g, unknown or other
  modified_base (383)..(383): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggaatacaacttatttggattggtacctgacagaagccagggcagtctccacaactctgatctatttggtctaagtcgggcctcggggtccccngactggttcagtgcnggtggatcgagcatagtatttacactanaaaatcagcagaggtggaggcgtaggaggtacggtttaggggtttatacgtgcagttgacgtaacggtcctaaccgaaaccccgtatccgtacccgttaccgggccggaagggtaccgaccgtccgtaggaacgtaacttaaaaccggacttaaggtcggacttcggacctaacctacgttcgttcg

SEQ ID NO: 422866 - DNA, 694 bp, Homo sapiens
  misc_feature: GZ8MTXP02IEAJM.15.25.C03.1.454.CMB.2.raw
  modified_base (489)..(489): a, c, t, g, unknown or other
  modified_base (595)..(595): a, c, t, g, unknown or other
tcagtctacgtagccacgaccggtgctcgatttagtagtgtagatttgggttgggggatcaggactcctcagttcaccttctcacaatgaggctccctgctcagctcctggggctgctaatgctctgggtctctggatccagtggggatattgtgatgactcagtctccactctccctgcccgtcaccctggacgacgccggcctccatcctcctgcgaggtctagtcagacgcctcagcatacgtgacgtgaactaacaacttgtttaggatttcggtacctgacgaagaacggccgagggctacgtccctacccaactacctaccgtgtacttacgtttagttttcgggtacttaacggtcccggggtaccgttcccggggtacccctacggtacgtacggtttcgaggttcggactggggtagtaacgtcgagggtactagttaaagtttacctttaaacaacgtaaagtaaaactcgacggtaanaaggggtagtgggaaaccgttgtaggggtaaacggttacggggttttaggtttactacgttcggattaaggtcgacgtaaacggttaaccaaaccgtaaacccgtntcccgtaaaccggtccggaacgacggggtacctacccgtaggttaacgaaaacgttaacgtaaccgaagtggtacgacgtacacgtactacgttccgtc

SEQ ID NO: 422867 - DNA, 563 bp, Homo sapiens
  misc_feature: GZ8MTXP02F3SRJ.15.25.C03.1.454.CMB.2.raw
  modified_base (263)..(263): a, c, t, g, unknown or other
  modified_base (363)..(363): a, c, t, g, unknown or other
  modified_base (365)..(365): a, c, t, g, unknown or other
  modified_base (388)..(388): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccacttctccctgccccgtcacccctggagacgccggcctccatctcctgcaggtctagcagacgccctccagcatactgatggatacaacttntttggattcggacctgacagaagccgaggcagtcctacacactctgactctagtttcggtactagtccgggcctcccggggtcctgactggtcagtggcngnggatcgaggctatagtactttanactagaaaatcagtcagaggtggagcgtgagggtacgtttgggttactagtgtactagtcgacgtacggtactaaccgaaaccgacgtaccgaccggttcggaccggacggggaccacggaccgtggaaacgtacgttaaaacgaacgtggtacgtacgtcgactaccagttccg

SEQ ID NO: 422868 - DNA, 598 bp, Homo sapiens
  misc_feature: GZ8MTXP02GO9FM.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcaccctggagagccgcctccatctcctgcaggtctagtcagagcctccagcatactgatggataacaatattgattggtacctgcagagccaggcagtctccacaactctgatcttagtttggttactaagtcgggtcccgtccggggtcccctgacgtaggttcaggttggcgtggtgatcgagctaagtagtattttacatagaaaatcagcagaggtggaggtcgtaggagggttacggtttaggggtttattacgtgactagtcgtacgtaaacggttacctaaaccgtaaaacccccggtatacccgtacccgttaccggggaccggacggggacccaccggccgtagggaaactaaacgttaaaacgaacgtcggtaggccgtacgacctaccgtacgttcgttaccg

SEQ ID NO: 422869 - DNA, 322 bp, Homo sapiens
  misc_feature: GZ8MTXP02HRXPU.15.25.C03.1.454.CMB.2.raw
  modified_base (265)..(266): a, c, t, g, unknown or other
  modified_base (268)..(268): a, c, t, g, unknown or other
  modified_base (270)..(271): a, c, t, g, unknown or other
  modified_base (273)..(274): a, c, t, g, unknown or other
  modified_base (276)..(276): a, c, t, g, unknown or other
  modified_base (282)..(282): a, c, t, g, unknown or other
  modified_base (284)..(285): a, c, t, g, unknown or other
  modified_base (287)..(287): a, c, t, g, unknown or other
  modified_base (289)..(289): a, c, t, g, unknown or other
  modified_base (293)..(293): a, c, t, g, unknown or other
  modified_base (296)..(296): a, c, t, g, unknown or other
  modified_base (306)..(308): a, c, t, g, unknown or other
  modified_base (311)..(311): a, c, t, g, unknown or other
  modified_base (313)..(313): a, c, t, g, unknown or other
  modified_base (315)..(322): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctcagcatactgatggatacatattgatgtacnnananngnncncacacncnntntntgtntancgcgcgcccnnngtngngnnnnnnnn

SEQ ID NO: 422870 - DNA, 678 bp, Homo sapiens
  misc_feature: GZ8MTXP02FK5SQ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctcgcccgtccacccgtggagacgccggcctccatcctcctgcagtctagtcagacgcctacagcatactgagtgataacaacttagttggattcggacctgacaagacgcgaggcagtccacactactctagtattacgttagtttcgggttactaacggtccggtcccgttccggggtcccctagtacgtaggttcaggtcggacgtggtacgactacggaggtactaagtttaagttaacttttaacgaacgttaaaagtaaaaccgacgtagtaacggtaggtagggtacggtacggtacggttaaggggttaacgggtttagggtttaggttacttacgtagtacgtaggtacgtaaccgtaaccgtaaccctaaacccgtaacccgtacgtacccgtaccggtaccgggaacggtacggtacgtaccgggtacgtaaacggtaaacgtaaacgtaacgtagtcggtcgtacgtaccgactacgtacgttacgtccg

SEQ ID NO: 422871 - DNA, 625 bp, Homo sapiens
  misc_feature: GZ8MTXP02I6KQV.15.25.C03.1.454.CMB.2.raw
  modified_base (258)..(258): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactnttggattggtacctgacagaacgcgaggcagtctaccacaacctcctgtacttcgttagtttcgggtactaacgtccggggtcccgtccggggtcccctgaccgtaggttcaggtcggactagggtggactcgaggctaagtagtaacttttaacgataagaaaatcgaagacgagtaggtggaggtcgtagggtacgggttaggtttaggggtttattacgtgtactagtacgacgtaacggtacctaaccgaaacccgtacgtaccgtaccgttccggaaccggacggaccgtaccggtacgtacggtaaacgtaaacgttaaacggaacgttggtacgtacgtcgacctacgtacttacgttcg

SEQ ID NO: 422872 - DNA, 569 bp, Homo sapiens
  misc_feature: GZ8MTXP02GEG99.15.25.C03.1.454.CMB.2.raw
  modified_base (425)..(425): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagacgcctccagcatactgatggatacaactattggattggtacctgcaagaagccgaagggcagtctccaacaactcctagacttcttatttgggttactaacgtccggggccttccggggtcctgactaggttcagtggcagtggatcgaggcaatagtattttacactagaaaatcagacagaggtggaacggngtaggaggtacggtttaggggtttactagtgcatagactaacggtactaaccgaaacccgtatccgaaccgtcggaccggaacggaccacgccgtaggaacgtacgttaaaacgactgtaagctacgaccacctatctcgttac

SEQ ID NO: 422873 - DNA, 701 bp, Homo sapiens
  misc_feature: GZ8MTXP02I78I8.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgccaggtctagtcagagccctcagcatctgatggatacaacttagttggattcggtacctgacagaacgccgagggcacgtcctaccaactaacgtcctgtattcttagtttcgggtactaacggtccggggtcccgttccccggggtccctaggacgtaggttcgaggttcggcgtaggtggactcgagctagtacgtatttacacgttagaaactcgaagtagaaggtaggtacggggaaggtcgtaagggtaacgggggttacgggtttttagggggtttaaacttaccgtggtacgtaaggttcgaacggtaacgggttaccctaaaacccgtaaaccccgtacgttacccgtacccggttaccggggacccgggaaccggtaaccggaccggtaccggtacgggtaaaacgtaaccggttaaaacggtaaccggttggtaccgggtaccttacggacccttaaccggtacttttcccgg

SEQ ID NO: 422874 - DNA, 781 bp, Homo sapiens
  misc_feature: GZ8MTXP02GQL98.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatggataacaacttagtttaggattcggtacctgcaagacgccgagggcagtcctaccaactaacctcctgtacttcttagtttgggttactaacgtccggggcccgttccggggtcccccctgacgtaggttacaggtcggacgtagggtcgactcgaggtactaagttaagttaacttttaaccaacgttaaacgaaaattacgaagacgtaaagggtaggttaggggaacggtaccggttaggggtaaacgggggtttaaccgggtttttaggggggtttttaaactttacgggttacggtaccgttaagggttacggtaaaccggttaaaccgggttaaacccgttaaaccccggaaaaacccccggttaccttaaccccggtaccccggtttaccgggggacccgggaaccggggtaaaccgacccggtaaccggtacgggtaaaaccgttaaaacgtttaaaaccggtaacggttaacgggtaacgggcctttacgggaaccctacccgtaacgtttccggtttaaccg

SEQ ID NO: 422875 - DNA, 626 bp, Homo sapiens
  misc_feature: GZ8MTXP02IEVJE.15.25.C03.1.454.CMB.2.raw
  modified_base (291)..(291): a, c, t, g, unknown or other
  modified_base (505)..(505): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgccggcctccatctcctgcaggtctagtcagacgcctccagcatactgatggatacaacttattggattggtacctgcagagccagggcagtcnccacaactctgatctagtttggtctagtccgggcctccggggtcccctgacgtggttcagtggctggtgatcgaggctagtagtacttttacatagtaaaatcaagcaagtacggtaggaaggtcgtaggacgggttagggtttacgggggttttaacttacgttgacgtagtacgtaaccgtaacggttacccttaaaccgaaaacccccgtntacccgtacccgtttacccggggaccgaaacgggaccgaccgtaccggtacgggtaacgtaaacgttaaaacgaccggtaaggtacggaccgttacggacctaaccgtactacggtttccg

SEQ ID NO: 422876 - DNA, 584 bp, Homo sapiens
  misc_feature: GZ8MTXP02FPLH2.15.25.C03.1.454.CMB.2.raw
  modified_base (369)..(369): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctccagcatactgatggatacaactattggattggtacctgcagaagccgagggcagtcctaccacaactcctgattctagtttgggttctaagtccgggccgtccggggtccccctgacgtaggttcaggtggcnggtggatcgaggctaagtagtatttacactagaaaatcagcagagtggaggtcgtaggagggttacggtttaggggtttattacgtgtactagtagacgtaacgtactaaccgaaacccgtactaccgtaccgttcggaccggacgggaccacgtaccgtaggtaacgtaaacgttaaacgtaagtggtcggacgtcgacctacctactcgttcg

SEQ ID NO: 422877 - DNA, 717 bp, Homo sapiens
  misc_feature: GZ8MTXP02FR1N8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagacgcctcagcatactgatggataacaacttgttggattcggtacctgacgaagaacgccgagggctagtcctaccaactacctccgtagtacttactttaggtttacgggttacttaacgggtccgggtaccccggttcccggggtaccccctacggaacgtaggttaccgaggtggacgtgggtagataccgaggtactaattacggttaattttaaacgaacgttaaagaaaactacgacggtaagaagggtaggtagggaaggtcgtaagggtaacgggtttaaggggttttaggggtttaaatacgtcgtacgtaagttacggacgtaaacggtacctaaacccgtaaaacccgtcgtaaccctaccggttacgggaaccgacggggaaccaacccggttacggtaacgaaacggttaaaaccgttaaacgtaacggtcgggttacggaccgtacgttaacccaccgttaactcggttttacccg

SEQ ID NO: 422878 - DNA, 619 bp, Homo sapiens
  misc_feature: GZ8MTXP02ICYCQ.15.25.C03.1.454.CMB.2.raw
  modified_base (366)..(366): a, c, t, g, unknown or other
  modified_base (397)..(397): a, c, t, g, unknown or other
  modified_base (402)..(402): a, c, t, g, unknown or other
  modified_base (406)..(406): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatgatacaactattggattggtacctgacagaagcccgaagggcacgtcctaccaactaactcctgattcgtatttggtactaagtccgggtccgtccggggtcccctgacgtgtcaggtgcnggtgatcgaggctatagtatttaaacactanaaatnaganagtaggtaggaggcgtagggtagggttacggtttaggggtttaattacgtgtacgttagacgtacgaaacggttacctaaacccgaaaacccggtacttaccgtaacccggttacccgggaccgggtaacgggtaccgacccggtaccgacgggtaaacgtaaacggttaaaccgaaccgttgacggtacgtcgaccgacctacgtctttacg

SEQ ID NO: 422879 - DNA, 632 bp, Homo sapiens
  misc_feature: GZ8MTXP02HHTBA.15.25.C03.1.454.CMB.2.raw
  modified_base (378)..(378): a, c, t, g, unknown or other
  modified_base (527)..(527): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcaccctggagacgccgcctcatcctctgcaggtctagtcagcgcctccagcatctgatgaatacaacttattgattcggtacctgacaggacgccgaggctagtcctaccaactaacctctgtactttcgtttagttttcgggtactaacggtcccgggtccgttccgggcccctaggacctggttcaggtcgntagggtgactgagtctaagttaagttaactttaacaactaaagtaaaactgaagacaggtagtggagtcgaggtaggtacgggttttagggttaacttagtcgagtagtacgtaacgtaacgtaaccgtaaaccccgtaaaacccggtnttaccccgtacgttccggggaaccggtacggaaccaacgtcggttaaacgacgttaaaacctaaacggagttcggtacgcctacgactaccgactttcgttaccg

SEQ ID NO: 422880 - DNA, 595 bp, Homo sapiens
  misc_feature: GZ8MTXP02HJDZF.15.25.C03.1.454.CMB.2.raw
  modified_base (420)..(420): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctcactctccctgcccgtcaccctggagagccggcctccatctcctgcaggtctagtcagagcctcagcatactgatggatacaactagttgattcggtactgacagaacgcgagggcagtctaccacaactctagactcttagtttggtactaagtccggtaccgtccgggtcccctgacgtgttcgaggtggcagtgactcgaggctagtagttatttaacactaagaaaatcagacgagtaggtggacggngtaggtagggtacggtttggggtttaattacgtagtactagtagacgtaaacggtacctaaaccgaaaccccgtataccgtaccgttaccggaccggaacggacgaccgaccgtaaggtaacgtaacgttaaaacgtaacgtcggtacggacgtacgaccacctacgttcttacg

SEQ ID NO: 422881 - DNA, 685 bp, Homo sapiens
  misc_feature: GZ8MTXP02HGZJU.15.25.C03.1.454.CMB.2.raw
  modified_base (264)..(264): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcaccctggagacgccggcctccatcctcctgccaggtctagtcagacgcctaccagcatactgataggataacaacttnttaggattcggtacctgacaaggaacgccgagggctacgtcctaccaacctaactcctagaattcgttagtttagggttactacggtcccggggcccgttccggggtccccctggacgtaggttcaggtggactggtcgaatccgaggctagtaaagttactttaaacgacttaagaaaactcgagacgaggtaggtagggaaggtcgtacgggttaggggttacggggttttaggggtttaataccgtgtactacggtaggtaaccgtaacgggttaacccaaacccgtaaacccgtacgtacccgtaaccggttcccgggaccgggtacggacccgtaccgggtaccgaggtaaacgtaaacgttaaaacggtaaccgtgggtacgtccgacggtaacctccgtaactttcggttcccg

SEQ ID NO: 422882 - DNA, 734 bp, Homo sapiens
  misc_feature: GZ8MTXP02GMKER.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagacgcctccagcatactgatggatacaactattggattcggtacctgacagaagccgaggcacgtcctaccaactaacctcctagtattcgttagtttcgggttactaacggtccgggtcccgttccggggtcccctggacgtagggttcgaggtcggactagggtggactcggaggtctaagttaagttaaacttttaacgaacgttaaaggtaaaacttacgaacggtaacgtaagggtagggttaagggggaacggtacgggtaagggggtaacggggtttaaccggggtttttagggggttttaaactttaccggtttagggaccttaaggttaccgtaaacggtaaaccggttaaccctaaaccccggtaaaaccccgttacgttaacccgtacccggttaccgggaacccggtaacgggaccgtaccggtaccggtaagggtaaacgtaaacgtaaaaccgtaacgtcggtacggcgtacgacctaacgtcttacgtttcg

SEQ ID NO: 422883 - DNA, 759 bp, Homo sapiens
  misc_feature: GZ8MTXP02H0DZ6.15.25.C03.1.454.CMB.2.raw
  modified_base (260)..(260): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagcgcccggcctccatcctcctgcaggtctagtcagacgcctccagcatctgatggatacaacttntttggattcggtacctgcaagaagccgagggcagtcctaccaacaactcctagtattctttagttttcgggttacttaaacggtccggggtacccgttccccccggggtacctacggtactaacggggtttcaaggttcgggccgtaagggttcgggaacgtccgtaaagggtcaaagtttaacggttaactttttaaccaaccgttaagttaaaacgtccgaaagtacgaaggggtaaggttggggaacgggtacgttagggaaccgggggtttaacggggtttagggggttttatttaaccgttcgtacgtaagtttaggaaccggtaaacgggtttaccctaaaacccgaaacccccggtaacttaccccgtaaccggtttacccggggaccgggttaacggggaacccgtaccggtaccgtacgggtaaagtaaaccgttaaaacggtaaccggttgttaacgggcttacggacccgtaaacgttactttcccgg

SEQ ID NO: 422884 - DNA, 692 bp, Homo sapiens
  misc_feature: GZ8MTXP02FHXWY.15.25.C03.1.454.CMB.2.raw
  modified_base (385)..(385): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagacgcctccagcatactgatggatacaacttatttggattcggtacctgacaagaacgccgtagggccagtcctaccaactaactcctagacttcttagtttcgggttctaaacggtccgggaccgttcccggggtcctaggaccgtagggttacnggtacggcgtaggtcgacgtacgacgtacgtagttaacgtaactttacaaacgtaacgtaaaactacgaacgtacgtaaggtacgggtacgggtacggtacggtagggttaacggggttacgggttttaggggtttactacgtacgtacgtagtacggtaacgtaaacggtaccctaaaccgtaaacccgtacgtaacccgtaccggttacgggaccgggtaacggtaccgaccggtacgtaacggtaacgtaaacgttaaacgaacgttcggtaacgtcgtacgaccgtaactcgtacgttcgtac

SEQ ID NO: 422885 - DNA, 687 bp, Homo sapiens
  misc_feature: GZ8MTXP02IA1RL.15.25.C03.1.454.CMB.2.raw
  modified_base (384)..(384): a, c, t, g, unknown or other
  modified_base (394)..(394): a, c, t, g, unknown or other
  modified_base (447)..(447): a, c, t, g, unknown or other
tcagtctacgtagccacgaccggtgctcgatttagtagtgtagatttgggttgggggatcaggactcctcagttcaccttctcacaatgaggctccctgctcagctcctggggctgctaatgctctgggtctctggatccaggtgggatattgtgatgactcagtctccactcctccctgcccgtcacccgtggacgacgcccggcctccactcctcctgacgtaggtctagtcagacgcctcagctatactgataggactaacaattagttgagttacgtactgacaagaacgtccgaggctacgtcctaccaactactcgtagtactttcgttagtttcggtactacggtccggtcccgtccgggtcccctagacgtcggtnaggtcgacgngtgactcggaagatagtagtttaactttaacgaaactaaagaaaactcgaagngtaaaggtaggtaggaggtacggtaggggttaacgggttacggggtttttaaggtttaacgttagtagtaactaggtacgtaacgtaaaccggttaaccaaaccccgtaacccgttactaaccggtacccggtaccgggaacgggtaaccggtacccgaaccgtaaccggtagtaaaaccgttaaacgtaaaacccgtcggtaagtaccgacgtacgaccctaactcgtttacgtacccg

SEQ ID NO: 422886 - DNA, 672 bp, Homo sapiens
  misc_feature: GZ8MTXP02GH40Y.15.25.C03.1.454.CMB.2.raw
  modified_base (247)..(247): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctggtctctggatccagtgggatattgtgatgactcagtctccactcctccctcgcccgtccacccctggacgacgccggcctccatcctcctgctagtctagtcagacgcctcagcatacngatagactaacaacttgttggattcggtacctgacagacgcgaggcacgtctaccactactcctagtacttcgtttagtttcggtactacgtccggggtcccgttccggggtccccctgaccgtaggtcaggtcggactgggtgactacgacgtaactagttaacgttacttttaacaacgttaaagtaaaactcgaagtacgtaaggtaggttacgggaaggtacggttaaggtaacggggtttacgggttttaagggtttaagttaacggtcgtacgtaggtacgtaaccgtaaacggttacccgaaacccgtaaaacccgtcgtacccgtacccggttaccgggaccggtacggacgaccgtcggaacgtaaacgtaaacgttaaacgacggtcgtacgactacgacacgttctcgtttacg

SEQ ID NO: 422887 - DNA, 814 bp, Homo sapiens
  misc_feature: GZ8MTXP02FWYRU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccactcctcctgcgtaggtctagtcagacgccctccagctatacgtgagtaggtaactaactaacttagttaggtattcggtacctagacaacggacgccgagggcacgtcctaccacaacctctagtactcttagtttcggttactacggtccggtccgtccggggtccctacgacgtacggttcgaggtcggacgtggtaggtactacgacggtacctaagttaacgtttaactttaaaccgaagttaaacggtaaactacggacgaggtaaggtacggtaggggtaccgaggttaaaggggacggggttttaaccggggtttttacggggtttaaatttaccggtccgtacgttaagggtaccgttaaaccggtaaccggggtttaaaccctaaaacccccgggttaaaaccccgtccggttaaacccggttcccccggggttaacccgggggtaacccggggtaaacggggaaaccccgtttaccggggaaccccggttaaaggggtaaaaccgtttaaaaccgggtaaaccccggttaagggttcggggtaaaccggtccgttacccggaaccccgttaaaccttggtttaacccctttacccgg

SEQ ID NO: 422888 - DNA, 594 bp, Homo sapiens
  misc_feature: GZ8MTXP02JBMHH.15.25.C03.1.454.CMB.2.raw
  modified_base (287)..(287): a, c, t, g, unknown or other
  modified_base (297)..(297): a, c, t, g, unknown or other
  modified_base (394)..(394): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctcatctcctgcaggtctagtcagacgcctccagcatactgatggatacaactattggattggacctgcagagccgaggcagtcnccacactctnatctagtttgggttctaagtccggggccttccggggtcccctgactaggttcaggtcggcaggtgactcgagctaattagtatttacactagaaatnagcgagaggtggaggtcgtagggtaggttacgggtttaggggtttattacgtggtactagtacgacgtaacgggttacctaaaccgaaacccggtactaccgtaccgttaccgggaccggacgggaccgaccggacgtacgggacgtaaacgttaaacggtaacgtggtcggtacgtcgaccgtactacgttactttccg

SEQ ID NO: 422889 - DNA, 718 bp, Homo sapiens
  misc_feature: GZ8MTXP02JXJDO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtccaccctggagacgccggcctccatcctcctgcaggtctagtcagacgcctcagcatactgatggactaacgtaacttattggtattggtacctgacaggaacgccgaggcagtcctaccacactctgtactcgttagtttggttactacgtccgggtcccggtccggggtccccctaggacgtcgggttacgaggtcggcgtagggtgggaagttccgaaggtactaagttaaacgttaacttttaaaccaaacgttaaaggaaaattaccggaagaacggtaggtagggtaggggtaacgggtcgtaaggggtaaccggggtttaaggggttttagggggtttaaacttacggtgtaagtacgtaggaaaccgttaacgggtaacccctaaaacccgtaaaccccggttagtacccgtaaacggttcccggggaacgggtaaacggaccggtaccggtaccggttaagggaaaacggttaaactaaaccggtaagtcggtaacggtctaccggactacgtactcgttacg

SEQ ID NO: 422890 - DNA, 624 bp, Homo sapiens
  misc_feature: GZ8MTXP02JMW4X.15.25.C03.1.454.CMB.2.raw
  modified_base (367)..(368): a, c, t, g, unknown or other
  modified_base (376)..(376): a, c, t, g, unknown or other
  modified_base (378)..(378): a, c, t, g, unknown or other
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtcacccctggagacgccgcctccatcctcctgcaggtctagtcagacgcctccagcatacgtgatggatactaacttagttaggattcggtacctgacaagacgccgaggcagtctccacactctatatcttagttggtactaggtccggtccgtccgggtcccctgacgtagtcgagtcgnngtgatcgngntagtatactttacactagaaatcganacgtagaggtggacggtgtagggtaagggttacgggttttagggtttaagttacgttgacgtagtacggtacgtaaacggtaccgtaaacccgtaaacccgtcctaccgtaccccggttacgggacccgggaaggacccgacgggtacccgtaggggtaaacgtaaacggttaaaccgaggtaacggtggtaaccacggtaccaccttacgtccgtttcg

SEQ ID NO: 422891 - DNA, 548 bp, Homo sapiens
  misc_feature: GZ8MTXP02GYF4L.15.25.C03.1.454.CMB.2.raw
  modified_base (245)..(245): a, c, t, g, unknown or other
  modified_base (291)..(291): a, c, t, g, unknown or other
  modified_base (371)..(371): a, c, t, g, unknown or other
  modified_base (413)..(413): a, c, t, g, unknown or other
  modified_base (418)..(418): a, c, t, g, unknown or other
  modified_base (450)..(450): a, c, t, g, unknown or other
  modified_base (483)..(483): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatacngatggataacattagttgattggtacctgcagacgcgaggcagtcncaacactctgtatcttagtttcggttactaacgtccggtccggtccggggtccccgtagacgtaggttcaggtcggacgngtgactcgagctatagtatttacactaagaaatcagcagagnggagngaggtaggttaggtttagggtttattacgtgngtagtgacgaacgtacctaaaccgaacccgtanaccgtaccgtacggacggacggacacgcgtacgagaacgtaacgactgcgactcgcactctcgtc

SEQ ID NO: 422892 - DNA, 779 bp, Homo sapiens
  misc_feature: GZ8MTXP02JW1EY.15.25.C03.1.454.CMB.2.raw
  modified_base (240)..(240): a, c, t, g, unknown or other
  modified_base (316)..(316): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtcctccactcctccctcgcccgtcaccccgtggagacgcccggcctccactcctcccgcaggtctagtcagacnccctccagctatactgatcggaataactaacttagttggtagttcggtacctgacgaacggaacggccgacggggntacgtcctacccactaactcctagtacttcgtttagtttacgggtttacctaacggttcccggggtcccggttccccggggtacccctaccgggtacgtacggggtttccgtagggtcggtaccgtaagggtcggtaaccgtcggtaagggtacctaagttaaccgtttaagtttttaaacccgaaacgtttaaagaaaaccgtacgaacggtacgtaaagggtacgggtagggggtacggtacggttaggggtacggggtttaacgggggttttacgggtttaacgttaacgtcggtacgtagtcgggtaaccgtaaaccggttacccaaaccgtaaaccccgtactaccggttaccgtacggtaccggaacggtaccgaccggtaccggtagggaaacgttaaaaccgtaaacgtacgttacggaacggtcgtacgacctacgtacgtcctacgtttcccg

SEQ ID NO: 422893 - DNA, 731 bp, Homo sapiens
  misc_feature: GZ8MTXP02JMANT.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggacgacgccggcctccatctcctgcaggtctagtcagacgcctacagctatactgagtggatactaacttagttggattcggtacctgcgagaacgccgagggcacgttccaccaactaacctcctagtacttacttagttttcggtaccttaaacgtcccggggtcccgttaccggggtccccctggaccgttaggttaccaggtcggtacgtaggtcggtaacgtacgaggtctaaagttacgttaacgttttaaacacgttaaacgaaaacttcgaggtaacgaggtaggtaggggaaggtcgtagggtaacgggttaacggggtttggggttttaaattacggtagtacgtagttaacgaacgttaacgtaacctaaacccgtaaacccgtacgttaacccgtaccggttaccggaaccgggtacgggaaccgtaccgggtaccgttaaacgggaaacgttaaaccgttaaaaccggaacggttaacggtacggtacgtaccggacctaacccgttacgttacgtttaacccg

SEQ ID NO: 422894 - DNA, 671 bp, Homo sapiens
  misc_feature: GZ8MTXP02JO6AZ.15.25.C03.1.454.CMB.2.raw
  modified_base (247)..(247): a, c, t, g, unknown or other
  modified_base (263)..(263): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagacgccggcctccatcctcctgcaggtctagtcagacgcctccagcattacngataggatactaattnttggattcggtacctgcagaagccgagggctagtcctacaactaactcctagactttgttagtttcggtactaacgtcccggggtacccgttccggggtcccctggtacgtacggttcgaggtcggctaggtcggagtacgagggtactaagttaggttactttaacccgattaaaggaaactacgtaagcgaaggtacggtaggacggtacgtagggtaagggtttaccgggtttaggggtttataccgtagtctaaggttacgaacgtaaaccggtacccgtaaacccgaaacccgtacgttaccccgaaccggttaccggaccgggaacggaccgaccggaccgtaggtaaacgtaaacgttaaaccgtacgtggtacggactacggaccacgtactcggttacc

SEQ ID NO: 422895 - DNA, 790 bp, Homo sapiens
  misc_feature: GZ8MTXP02FQ7NO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctggtctctggatccagtgggatattgtgatgactcagtcctccactcctccctcgcccgtccaccccgtggacgacggcccggcctccactcctcctgcgtagtactagtcagacgcctcagacatactgagtagtaactaactaacttagttggtagttcggtactagacaaggacgccgaggctacgtcctaccgaactactctagtacttacttagtttacggttactacggtcccggtcccggtaccgggtccctagtaccgtagtccggtagtcggcgtaggtgacgtacgacgtataagttaacgttaacttaaaccgaagtaaaagtaaagtaccgaagtaagaaggtacggggttaagggacggtttacggacggggttaacgggtttaacggggtttttacggggttttaaattaccggtaggtacccttaaagggggttacaaaaccccgggtttaaacggtaaacccctaaaacccccgggtaaaacccggttcaacccccggttttaacccggggtacccgggaaaaccggttaacccggggaacccttacccccggggaaaaggttaacgggtaaacgtttaaaacgaaacccggtaagttccgggtacgtacttaaccggacttaacccctaggtttccgttttaacccg

SEQ ID NO: 422896 - DNA, 886 bp, Homo sapiens
  misc_feature: GZ8MTXP02GV5R7.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtcctccactcctccctcgcccgtccaccccgtggacgacgcccggcctccacttcctcctgctaggtctagtcagacgcctccagcatactgatggatacaacgttagttggtattcggtactgacagaacgcgaggcagtccaccactacctctagtattcgttagtttcggttactaacggtcccggtccccggttccggggtccccctacgtacgttacgggttacgacggttggacgtggggtacggtaacgtcggtacggtaccgtaaagtttaaacgggtttaacctttttaaaccgaacgttaaaacggtaaaacgttaccggaaacggtaaccgggtaaagggttacgggggttaaagggggtaacggggttaccgggttaaacgggggttaaagggggtttttaaacccgggggttttttaaggggggttttaaaactttacccggggttagtaacccggttaagttaaccgggttaaacccggtaaaaccggggtttaaaccccctaaaacccccggtaaaaccccccggttacgtttaacccccggtaaaccccggggtttaccccggggaaccccggggtaaaaccgggggacccgtaacccggggtaacccggttaaacggggtaaaacgttaaaaccggttaaaacccggttaggtaaccgggtcgtaacggtaccgaaccttaaccggttacctttaccgtttcccg

SEQ ID NO: 422897 - DNA, 614 bp, Homo sapiens
  misc_feature: GZ8MTXP02FYHT1.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagacgccggcctccatcctcctgcaggtctagtcagagcctccagcatactgatggatacaactattggattggtacctgacagaagccgaggcagtctaccacaactcctgtatcttagtttggtactaagtccggggtcccttccccggggtccagtactaggttcaggtgcgtaggtggactcgaggactaagtagtatttaacactagaaaatcgaagacgaggtagtagggaggtacgtagggtaacgggttaacgggtttaggggtttaattacgtagtacgtagtagtacgtaaaggtacctaaaccgaaaccccgtatacccgtaccgttacgggaccggaagggtaccaccggtacgtaggaaacgtaacgttaaaaccgaagtcggtcggtactacgaccactacgttcg

SEQ ID NO: 422898 - DNA, 688 bp, Homo sapiens
  misc_feature: GZ8MTXP02JFQ95.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctcgccccgtccaccccgtggacgacgccggcctccatcctcctgcgaggtctagtcagacgccctccagcatactgatgatacaacttagttggtattcggtacctgacagaacgccgaggcagtcctccactaactctgtattacgtttagtttagggttacctaacggtcccggggtcccggttccggggtaccccctgaccggttggttccgaggttcggacgtagggtgactacgagtactaagtacttaactttaaccaattaaaggaaatacgaagacgaaggagggtagggtacggtagggtacgggtaacggggtttaacggggtttaggggttttaattaacggtcgtaaccggtagttaacggaaccgttaaacggtaaccctaaaacccgtaaacccgtactacccgtaccggtaccggtaccgggacggtaccgacgtccggtaaggtaaacgtaacgtaacgacggtgcggtctacgactaccgtcgttacgtcc

SEQ ID NO: 422899 - DNA, 699 bp, Homo sapiens
  misc_feature: GZ8MTXP02HXWAR.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatatgtgatgactcagtatccactctccctgcccgtcaccctggagacgccggcctccatctcctgcaggtctagtcagacgcctccagcatactgataggatacaaacttatttgggattggtacctgacaagaacgcagggcagtcctaccaacgaactcgtgtatcgttaagtttcggtactaacgtcgggtccccgttcccggggtccctagaccgtaggtttcacggttggacgaggttggactaccgaggtactaagttaacgttaattttaacaaccgttaaagaaactacgaagtacgaaggtaggtacgggacggtacgtaacgggttaagggtttacgggttttaagggtttaacgtttaacgtacgtacgtagtaacggtaaccgtaaacggttaaccctaaacccgaaacccgtacgtacccgtaccggttaccgggaccggtaaccgggaaacccgtccgggtaacgtaacgggtaaactaaaacgttaaaaccggaacgttacggtacggtctaccgtaaccgtaccttacgtacg

SEQ ID NO: 422900 - DNA, 751 bp, Homo sapiens
  misc_feature: GZ8MTXP02JZVVL.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctcgcccgtccacccgtggacgacgccggcctccactcctccgtgcgtacggtctagtcaggacgccctacgagctatacgtgagtaggactaactaaacttagtttggtagttacggtactcgacgaaggaacgcggagggcacgtcctacccaacacctcctgtacttacgtttaagtttggtacgttacgtccggggtaccggttcccgggtcccctgacgttacgtcgaggtcggcgtacgggtgacgttacgaggtactaagtttaaacgttaactttaaccgaaacgttaaaggtaaaactacggtaaacggacgagggtaagggttaggggaacggttacgggtaggggtaacggggttttaacggggttttaggggtttaacttacggtagtacgttaagggtacgtaacggtaaaccggtaaaccgtaaaccccgaaaacccggtcttaacccgacccggttcccggggaaccggacgggtaaccgaccggttaaccggtaggtaaaacttaacggttaaaccgtacggtggttacgaccgacgtaccacttacgtctttaccg

SEQ ID NO: 422901 - DNA, 735 bp, Homo sapiens
  misc_feature: GZ8MTXP02F98LI.15.25.C03.1.454.CMB.2.raw
  modified_base (471)..(471): a, c, t, g, unknown or other
  modified_base (491)..(491): a, c, t, g, unknown or other
  modified_base (550)..(550): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccaccccgtggagacggcccggcctccatcctcctgccgaggtctagtcagacgcctccagccattactgacgtggtaataactaacttagtttggatttacgggtacctgacgaaggaacgccgaagggctacgtaccctaccaacctacctcgtgtattactttagtttcgggttactacggtccgggtccccgttccgggtcccctaggacgttaggttcgagttcggactgggttagacgttaccgaggttactaagtttattaactttaaccgagtaaanaaaacgtcgaaggtgaaagngggtaggacgggtcgtaggggtacggggtttacggggttttagggtttaactaccggtnacggtaagtcgaaccgtaacggttacccaaaacccggtaacccgtacgttacccgtaacccggttcgggaaccggaacggggtaacctacccgggtgttaaacggaacgtttaaaacgttaaccggtaacggttgggttaccggacgttacccggaaacgttccgtaactttcccggtttaaccg

SEQ ID NO: 422902 - DNA, 520 bp, Homo sapiens
  misc_feature: GZ8MTXP02FLBK2.15.25.C03.1.454.CMB.2.raw
  modified_base (179)..(179): a, c, t, g, unknown or other
  modified_base (257)..(257): a, c, t, g, unknown or other
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctgggctgctaatgctctgggtctctggatccagtggggatattgtgatgactcagtctccactctccctncccgtcaccccctggagagccggcctccatctcctgcaggtctagtcagagcctccagcatactgatggatacaactntttggattggtacctgcagaagccaggggcagtctccacaactcctgatctatttggggttctaaatcgggcctccggggtcccccctgcaggttcagtgcngtcggatcagcatagatttttacactgaaaatcagcagagtggagggctgaggacgttggggtttattactgcatgcaaggtctacaaccccgatcacttcggccgaggacacgtacctcggagacgttaacgaaccaagttggctcgcaccactcgttcg

SEQ ID NO: 422903 - DNA, 635 bp, Homo sapiens
  misc_feature: GZ8MTXP02F4HID.15.25.C03.1.454.CMB.2.raw
  modified_base (262)..(262): a, c, t, g, unknown or other
  modified_base (316)..(316): a, c, t, g, unknown or other
  modified_base (621)..(621): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggacgacgcccggcctccatcctcctgcaggtctagtcagagcctccagcatactgatggatacaacttnttggattggacctgacagacgccgaggcagtctaccacactctgatctattgtnttctaagtccggtcctccccggggtcctagacgtacggtttcgacggttgggcctaggtcggtagtaccgagggtactaaagtaacgttaacttttaacgacttaagaaaaacttcgaagtacgaggtaggtaggaggtcgtaggtacgggttacggtttgggggtttaattacgtacggtactaagtacggacgtaaacggttccctaaaccgaaaccccgtaagtaccgaccgtttaccgggaccggaaggaccgacggtacccgtaggaaacgtaacttaaaacgaacgttcggtagccgtnaccactactttccg

SEQ ID NO: 422904 - DNA, 695 bp, Homo sapiens
  misc_feature: GZ8MTXP02IH491.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactctccctgcccgtcaccctggagacgccggcctccatctcctgcaggtctagtcagacgcctcagcatactgatggatacaactagttgattggtactgcagaacgcgagggctacgtcctaccactaactccgtagtacttcgttagtttggttacctaaacgtccggggtccgtccggggtcccctgaccgtagtcgaggtgactggtggtactcgaaggctaaagttagttacttttaaaccgaacgttaaagaaaacttcgaagacgaagggaggttaggggacggtcgttagggtacggggttacgggttttagggggttttaaagttaccgttagacgttacggtacggtacggaaacgggtttaccctaaacccgtaaaaccccggtactacccgtaacccgttccggggaacccgggaacggggaccaaccggtccggtaacgggaaacggttaaaacgttaaaacgtaaaccggtggtaccggttacgcggacctaaccgtactttaccgttcg

SEQ ID NO: 422905 - DNA, 716 bp, Homo sapiens
  misc_feature: GZ8MTXP02GK0TM.15.25.C03.1.454.CMB.2.raw
  modified_base (418)..(418): a, c, t, g, unknown or other
  modified_base (426)..(426): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtcctccactcctccctcgcccgtccaccccgtggacgacgcccggcctccactcctcctgctaggtctagtcacgacgcctaccagctatacgtgagtggtaactactaacttagtttggatttacggtcctagacaggaacgccggacggctacgttacccaccaccgtaaccttcgtacgtacttcgttttaaggtttcggttactaccggtccgggtccccgttccggggtcccctggtacgtggttacgnggtccggntgggtgactaccggagtacctagtttaagttactttaacgacgtaaacgaagtacgacgaagagtagggtaggggacgacgggtagggttacgggtttaacggggtttagggttttactacgttcgacttagtacgtacgtaaaccgtaaccgtaaacccgtaaaccgggttactaacccgggtaaccgttcccggggtaaccggacggaccgtaccgtaaacggtaacggaacgttaaaacgtaaccggtacgtaaggtcgaaccggtctacacgttacttccgttacg

SEQ ID NO: 422906 - DNA, 674 bp, Homo sapiens
  misc_feature: GZ8MTXP02GUTNL.15.25.C03.1.454.CMB.2.raw
  modified_base (479)..(479): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatcagtgggatattgtgatgactcagtctccactcctccctcgcccgtccaccccgtggacgacgccggcctccattcctcctgctaggtctagtcagcgcctcagcaatctgagtgaatacaacttgttgtattcggtacctgacgaaggaacgccgagggtcacgtcctaccaaccgtaacctcctagtacttacgtttagttttcgggttactaaacggtcccgggtaccccggttccggggtcccccgtagtaccggtggttacgtaggtcgacgtaggtgatcgaggatagttattactttaacataaaggtaaactacgagacgtagtaggtaggnggtacgtagggtaagggttacgggtttagggtttaattacggtagtcgtagtcgtaacgtacgtaccctaaacccggtaaaccctacgtacccgtaccgggtacggtaccggacggtaccgtaccgtacgacggtaaacgtaacgtaaacgtacggttaacgtacgacgttacgaccgtactacgttacgttacg

SEQ ID NO: 422907 - DNA, 842 bp, Homo sapiens
  misc_feature: GZ8MTXP02I0GYI.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtcctccactcctccctcgcccgtccaccccgtggacgacggcccggcctccactcctcctgcgaggttcctaggtcacgacgtccctaccgagctatacgtgaagtggaactaactaacttagtttaggattcggtacctgacgaggaacgccgaggcacgtccaccaactaacctcgtatactacgtttagtttcggttactaacggtccggggtccgtccccggggtccctacggacgtacgttcggtaagtcggacgtaggtcgggactacgaagggtcctaaaggttaactttaacgtttaaaccaagttaaacgtaaaaacgtcgtaaacggcgaaacgggttacgggtaggggtaacggtaccgggtaagggttacggggtttaaaccggggttttcgggggtttttaaaattcgttacgtacgttaaccggtacgtaacccggtaaaccggttaaccgtaaacccccgtaaaaccccggttaccgttacccggtaaccccgggtttaccccggggaaccgggtaaccggggaaacccgtaccggggtaaaccccggttaaggggtaaaaccgttaaaaacggtttaaaaccccggttaaaacgggtcggggtttaaccggtacgttaaccccgtaccggttaaccctttaacgtttacccgttttacccgg

SEQ ID NO: 422908 - DNA, 682 bp, Homo sapiens
  misc_feature: GZ8MTXP02HX93I.15.25.C03.1.454.CMB.2.raw
  modified_base (420)..(420): a, c, t, g, unknown or other
  modified_base (624)..(624): a, c, t, g, unknown or other
tcagtctacgtagccacgaccggtgctcgatttagtagtgtagatttgggtttgggggtgatcaggactcctcagttcaccttctcacaatgaggctccctgctcagctcctggggctgctaatgctctgggtctctggatccagtggggatattgtgatgactcagtatccactctccctgcccgtcaccctggagacgcccggcctccatctcctgcaggtctagtcagacgcctcagcatactgatggatactaatagttggatttcggtacctggacaagacggccgagggctacgtcctaccaactaacttcctaggtactttagtttaggttttcgggtacttaacggtccggggtccgtccccggggttccctagtacgtacgggttcacggttcggcgtagggtcggtaaanccgtaagggacctaattaaacgttacgtttttaaacaacttaagtaaactcgaacgacgaaggtagggtagggagggttagtgggtaaggggtttacgggttttaggggttttacttaacgtgtacgtagttacgaccgtaaaggttacccaaaacccgtaaacccgacgtaccgtaccggttacgggacccgaggggaacccncggtacgtaaggtaacgtaaacgtaacgaacggtcgtacggactacgtactactctcg

SEQ ID NO: 422909 - DNA, 593 bp, Homo sapiens
  misc_feature: GZ8MTXP02GN2KR.15.25.C03.1.454.CMB.2.raw
  modified_base (371)..(371): a, c, t, g, unknown or other
  modified_base (373)..(373): a, c, t, g, unknown or other
  modified_base (379)..(379): a, c, t, g, unknown or other
  modified_base (394)..(394): a, c, t, g, unknown or other
  modified_base (398)..(398): a, c, t, g, unknown or other
  modified_base (403)..(403): a, c, t, g, unknown or other
  modified_base (408)..(408): a, c, t, g, unknown or other
  modified_base (437)..(437): a, c, t, g, unknown or other
  modified_base (476)..(476): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggacgacgcccggcctccactctcctgcgtaggtctagtcagacgcctcagcatactgatgatacaacttgttggattcggtactgcaagacgccgaggcagtcctccaacactctgtacttcttagtttggtactacgtccgggcccgtccggtccctgacgtgtcaggtcgctgngntcgagnagtactattacatanaaancaganagagnggagctaggacgttaggttggttatcgtncgtagtcgaacgtaacggtacctaaacccggaaaccctntaccgtaccggtaccggacgggaccggacgaccggtaccgtagggtaaaacccgttaaaacgttaaaccggacgtaacggtacggactaccggtaaccaccttactcggtttacccg

SEQ ID NO: 422910 - DNA, 548 bp, Homo sapiens
  misc_feature: GZ8MTXP02JQAB3.15.25.C03.1.454.CMB.2.raw
  modified_base (349)..(349): a, c, t, g, unknown or other
  modified_base (462)..(462): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggatggtacctgcagaagccagggcagtctcacactctgatcttattcgggtctagtccgggcctcggggtcccctgactgtcagtgcngtgatcgagctatacgtatttacactaagaaatcgagcagaggtggagtcgtaggaggtacggtttgggttaaatcgtgctagtgacgtaaggtactaaccgaaaaccccgtntaccgtaccgttcggaccggaaggtccaacgaccgtagggaacgtaacgttaaacccgagtggtacgctcggacacctagtcttcg

SEQ ID NO: 422911 - DNA, 562 bp, Homo sapiens
  misc_feature: GZ8MTXP02FU66T.15.25.C03.1.454.CMB.2.raw
  modified_base (273)..(273): a, c, t, g, unknown or other
  modified_base (284)..(284): a, c, t, g, unknown or other
  modified_base (287)..(287): a, c, t, g, unknown or other
  modified_base (292)..(292): a, c, t, g, unknown or other
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacatattgattggactgcaganccaggcagtcncanactcngatctattgggtactagtcgggcctccggggtcccctgactaggttcaggtggacnggtggatcgagctatagtatttacactagaaaatcgagcgtagaggtggaggtcgtaggtaggtacggtttaggggtttattacgtgtactagtgacgaaggtacctaaccgaaaccccgtataccgtaccgttacgggaccggtacgggacgacgaccgtaggtaacgtaaacgtaaacgaacgtggtacggctacggactaccgtatcgtcg

SEQ ID NO: 422912 - DNA, 762 bp, Homo sapiens
  misc_feature: GZ8MTXP02FIJ7J.15.25.C03.1.454.CMB.2.raw
  modified_base (437)..(437): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccacccgtggagacgcccggcctccatcctcctgccaggtctagtcagacgccctccagcatactgatggatacacttagttgattcggtactgcgaaggaacgccgagggctacgtcctaccaactaacctcctagtacttccttagtttcggggttactaaacggtccggggtccccgttacccggggtccccctggtaaccgtagggttccaagggtcggtactaggggtcggaattccggaagggtntaacgtttaagttaactttttaaacccgtaacgttaaacggaaaaacttcgaaacgtacccgtaaaggggacgggttagggggaacggtacggttagggtaaacgggggtttacgggggttttacgggggtttttaacttacgtacgggtactaagggttacgaccgttaaacgggtacctaaaccccgtaaacccgtcgtacccgtacccgttcccgggaacccggacgggtaaccaccggaccgtacgggaaacggttaaaactaaaaccggtaaacgttgggcgttaccgacggtaccctaaaccgtagttcccgtttacgg

SEQ ID NO: 422913 - DNA, 591 bp, Homo sapiens
  misc_feature: GZ8MTXP02INF3Z.15.25.C03.1.454.CMB.2.raw
  modified_base (293)..(293): a, c, t, g, unknown or other
  modified_base (302)..(302): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagagccggcctcatctcctgcaggtctagtcagagcctccagcatactgagtggaatacaaatatttggattggtacctgacagaagccagggcagtccncacaactcngatcttatttggtctaagtccgggcctccggggtcccctgactggttcagtggcngtcggatcaggctagtagttatttacactagaaaatcagacgagaggtggaggacgtaggaagggttacggtttaggggtttatacgtgctaagcgtacgaggtactaaaccgtaaacccgataccgtaaccgttccgggaccggtacgggaaccgaccgtaccgtagggaacgtaaaacgttaaaccgtaaattcgggtacggaccgtacggtacaaaccctgttacgtttcg

SEQ ID NO: 422914 - DNA, 717 bp, Homo sapiens
  misc_feature: GZ8MTXP02G3J3X.15.25.C03.1.454.CMB.2.raw
  modified_base (251)..(251): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtcctccactcctccctcgccctccacccgtggagacgccggcctcactctcctgctaggtctagtacagacgcctcagctatacgngatgactaactaacttgttagtattcgcctgacgagacgccgaggctacgtccacaactactcgtatcttacgtttagttacgtacgtaaccggtccggtcccggttccggtaccccgtaggtaccgtggttaccgtaggtcggacgtagggtcgtaacggtccgaaagggttacttaaagtttaaacggtttaacctttaaaccgtaagtaaaacggtaactccgaaggtaccgaagggttaacggggaggtacgggttacggtagggttacccggggtttagggttttaaagggtttcttacgacgattaagtcgaaaccgtaaccgttaaccaaacccgtaaccgcttacccggtacggtacgggaccggaaacgtcccggaaacgtacggtaaacggtaaaacttaacggtaaacggtcaacgggtactaccgtaacgttacctaacctgtttacctttcgg

SEQ ID NO: 422915 - DNA, 558 bp, Homo sapiens
  misc_feature: GZ8MTXP02GUGSG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgacagaagccagggcagtctcacaactctgatctattgggtctaagtcggcctccggggtcccctgactaggtcagtggcaggtgatcaggtcatagtatttacatagaaaatcagcagagtggagctagagtacggttggggtttatacgtagctaagtgacgtaaggtacctacgaaaaccccgatacgaacccgttacggacccggacggggaccgacgcccgtaggacgtaaacgttaaaacgacgttaaggtcggacgttcgaccacccaattacccgttg

SEQ ID NO: 422916 - DNA, 604 bp, Homo sapiens
  misc_feature: GZ8MTXP02FHHG9.15.25.C03.1.454.CMB.2.raw
  modified_base (414)..(414): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtccaccctggagagccggcctccatctcctgcaggtctagtcagagcctccagcatactgatggatacaacttattggattggtacctgcagaagccagggcagtcctccaacaactcctgatcttagtttgggttactaaggtccggggtcccgttccgggggtccccctggaccaggttcaggtggcaggtggatcgagggctaagtagtaacttttacaacgttaanaaaagtcaaggctaaggaggtgggaggtcgtaggtagggtacggtttggggtttattacgtgactagtagacgtaaacggtacctaaacccgaaaccccgtagtaccctaccggttaccgggaccggacgggaccgacggccgtaggacgtaaacgtaaaccgagtgtcggactacgaccaactctctcg

SEQ ID NO: 422917 - DNA, 643 bp, Homo sapiens
  misc_feature: GZ8MTXP02HZWUP.15.25.C03.1.454.CMB.2.raw
  modified_base (250)..(250): a, c, t, g, unknown or other
  modified_base (451)..(451): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctgcccgtcaccccgtggacgacgcccggcctccacttcctcctgcaggtctagcagcgcctccagcatacngataggataacaacttagttggattcggacctgacgagacgcgaggctagtcctaccaacgtaactcctgtacttacgttgttttacggttactaacgtccggggtcccgttaccggggccctacgacgtggttacgagttcggctggcgataccgagacttaagtagtttaactttacgaactaaacgtaaaatcgaacngtaaggaggttaggacgggtacgtaggtagggttacgggtttagggtttactacgtcgtacaaggtcgaacgtaaccggtacctaaaccaaccgtataccgtaccgtccggacggtacggtacgacggtccgtaaggaacgtaacgttaaacggaccttggagtaccgtacgactaccctacgtttccttcg

SEQ ID NO: 422918 - DNA, 596 bp, Homo sapiens
  misc_feature: GZ8MTXP02F7VI6.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattgattggtacctgacagaagccaggcagtctcacaactcctgatctatttcgggttctaagtccggtacctccggggtccccctagacctaggttcaaggtcggcaggtgatcgacggcaagtagtacttttaacactaagaaatcagactagagtggagtctaggaggtaggtttacgggttattacgtagactagtgacgtaacggtactaaccctaaacccggctaccgacccgttcgggaccgtacgggacccacggtaccgacggtagtaaaacgttaaaaccggtaaatcggttcggaaccgttcgaccaaccgtaattccggtttaaccg

SEQ ID NO: 422919 - DNA, 674 bp, Homo sapiens
  misc_feature: GZ8MTXP02IST87.15.25.C03.1.454.CMB.2.raw
  modified_base (262)..(262): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccacccctggagacgccggcctccatctcctgcaggtctagtcagacgcctccagcatactgatggatactaactntttaggattcggtacctgacaagaacgcccgagggcacgtcctaccaacaacctcctagagttcttagtttcggttctaacgtcccggggccgttcccggggtccccctaggacgttacggttacgtaggttcggctaggggtggtacgtaccgagggaccttaagtaacgttaacttttaacaaccgtaagtaaaactcgaagacgtaaggaggttaaggggaggtacggtagggtaggggtttacgggttttagggtttaacgttacgtagtacgtagtacgtaacgtaaccgtaaccgtaaacccgtaaacccgtctacccgtaccggtacggacggacggacgaccggtacgtaacggtaaacgtaaacgtaacgtagtcggtcgtacgtacgactactcgtacgtcg

SEQ ID NO: 422920 - DNA, 622 bp, Homo sapiens
  misc_feature: GZ8MTXP02IM59E.15.25.C03.1.454.CMB.2.raw
  modified_base (231)..(231): a, c, t, g, unknown or other
  modified_base (293)..(293): a, c, t, g, unknown or other
  modified_base (367)..(367): a, c, t, g, unknown or other
  modified_base (374)..(374): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagngcctcagcaatactgatggatacaactatttggattggtacctgcagaagccgaggcagtcnccacaactctgattcttgtttggtactaacgtccgggccgttccgggtcccctagactgggttccaggtcgcgnggtacgntacgaggactagtacgttatttacagtaacgtaaatcgacgtagagtaggtacggaggacgtaggggtacgggttaacgggttttacgggggttttaattaccggttgacgtaagtacgtacgaaacggttacctaacccgtaaaaccccggtctaacccgtacccgttacgggacccggtacggggaccacgtccggtaggaactaacgtaaacgagttaacggcgacgtcgacaccgtactcgtcg

SEQ ID NO: 422921 - DNA, 580 bp, Homo sapiens
  misc_feature: GZ8MTXP02G2LWL.15.25.C03.1.454.CMB.2.raw
  modified_base (293)..(293): a, c, t, g, unknown or other
  modified_base (299)..(299): a, c, t, g, unknown or other
  modified_base (305)..(305): a, c, t, g, unknown or other
  modified_base (402)..(402): a, c, t, g, unknown or other
  modified_base (408)..(408): a, c, t, g, unknown or other
  modified_base (414)..(414): a, c, t, g, unknown or other
  modified_base (421)..(421): a, c, t, g, unknown or other
  modified_base (450)..(450): a, c, t, g, unknown or other
  modified_base (487)..(487): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccccgtggacgagccgcctccatctcctgcaggttcaggtcagacgcctccagcatactgagtcgatacgattagttcgattcgactgacagacgcaggcagtcncatacnctgatntagttggtactagccggtctccggggtccctagctagggttcaggtcgactaggtcgaactcgaggctagtaacgtctttacgaacttagaaaactnaacgtnaggagnggacggntagtagggtacggtttagtttaattcganactagagtaccgtaaggttaccaaccgtaaaccccgntaccgtaccgttcgggaccgtaggaccgtaccgacgtaggtaaacgtaaacgtaacggaactggttacgactacgacctaccttcttacgtcg

SEQ ID NO: 422922 - DNA, 696 bp, Homo sapiens
  misc_feature: GZ8MTXP02IIARK.15.25.C03.1.454.CMB.2.raw
  modified_base (460)..(460): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtcctccactcctccctgcccgtccaccctggagacgccggcctccatctcctgcgaggtctagtcagacgccctaccagcaactacgtgaagtggaactaactaaacgttagttaggaattggtaccctggacaagaacgcgtaggcacgtccaccacaactcgtagactcgttagtttggtactaacggtccggtacccggtccgggtcccctagtacgacgttcgaggtcggactggggtcgaatacgagtacctagtaacgttatttaacagtaacaaaatcgagagtaaggnggtaaggtacggtagtagggtacgggtttaaacggtttacgggtttaaattcgtacgtatacggtagtaaccgttaaaggtaacccctaaaacggtaacccctacggttaaccgtacccgggttaccgggaacggtaaaacccggacgaaccggtaaccggtaaaggtaaacgtaaaacccgtttaaagacggtaacgtcggtaactacccggaactactaacggtttacttaccg

SEQ ID NO: 422923 - DNA, 545 bp, Homo sapiens
  misc_feature: GZ8MTXP02FFVOY.15.25.C03.1.454.CMB.2.raw
  modified_base (469)..(469): a, c, t, g, unknown or other
tcagtctacgtagccacgaccggtgctcgatttagtagtgtagatttgggtttggggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtcctaccacaactcctgatctatttggggttctaagcgggcctccggggccccctgacaggttcaggtggcaggtggatcaggcatagattttacacttagaaaatcagcagagtggaggctaggagggtacggtttgggggtttattacgtgacatgacaaggtactaaccaaaccccganccaccgttcggccggtaacgggacacgccgtaggaacgtaacttaaacgaactgtggactcgacacaactcttacg

SEQ ID NO: 422924 - DNA, 662 bp, Homo sapiens
  misc_feature: GZ8MTXP02JJ3K6.15.25.C03.1.454.CMB.2.raw
  modified_base (252)..(252): a, c, t, g, unknown or other
  modified_base (265)..(265): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctcgcccgtcacccctggagacgccggcctccactcctcccgcaggtctagtcagacgcctccagcatactganggaatacaacttnttggattggacctgacaagagcgaggcacgtcaccaacactctagtacttcgttagtttcggttactacggtccgggtccgtccggggttccacggtacgtaggtctaggtcggacgtagtcggtactacgaggactaagttagttacttttaaacgaacgttaaagtaaaactcgaaggacgtaaggggtaggtacggggaggtacggtaggggtaacgggttacggggttttagggtttattacgtggtactagtacggaacgtaacgtaccgtaaaccgtaaacccgtctacccgtaccggtacggaccggtaacggaccgtacggaacgtaacggaaacgtaaaccgtaacgtacgcgtcggtactacggacctcgtacttcgtacgtttacc

SEQ ID NO: 422925 - DNA, 742 bp, Homo sapiens
  misc_feature: GZ8MTXP02G3FON.15.25.C03.1.454.CMB.2.raw
  modified_base (308)..(308): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatatgtgatgactcagtctccactcctccctcgcccgtcacccgtggacgacgccggcctccacttctccctgctacggtctaagtcagacgtcctccgaagctatacgtgaagtgaactactaacttgttcggaattcggtactgacgaggacgtaccgnggtcacgtaccacctaacaacctcgtagtacttcgtttaaggttgttacctacggtcccgggtcgttacccggcctagacgtaggttcgacggtcggcgtagttgacgtaacgacggtactaaagtaacgtttaaactttaacaaacgttaagaaaagttccgaacgtacgaaaggtcgggttaaggacgtcgtaaaggtaacggggtttaggtttacgggtttaacttacgggacgtaacgtacggtaccgtaaccggttaaaccgtaaccggtaaacccgtaaacccggttcgttaaccggtaccggggtaaccgaacgggtaacccggtaccgtacccggtaaacggtaaaacgggtaaccggttaaaaacggtaaccgtagggtaaccggtacggacgtaccgtaacgtacgttaaccgtttacttccgg

SEQ ID NO: 422926 - DNA, 591 bp, Homo sapiens
  misc_feature: GZ8MTXP02GPZ08.15.25.C03.1.454.CMB.2.raw
  modified_base (396)..(396): a, c, t, g, unknown or other
  modified_base (442)..(442): a, c, t, g, unknown or other
  modified_base (487)..(487): a, c, t, g, unknown or other
  modified_base (491)..(491): a, c, t, g, unknown or other
  modified_base (567)..(567): a, c, t, g, unknown or other
  modified_base (574)..(574): a, c, t, g, unknown or other
  modified_base (581)..(581): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggacgacgccggcctccatcctcctgcaggtctagtcagacgcctaccagcatactgataggatacaacttattggaattcggtacctgacagacgccgagggcacgtctacccactaactcctgtacttcgttagtttcggggttactaagtccggggccgttccggggtacccccctggaccgtaggttccgaggtaggacnggttggaactcgaagggactagtagttaactttacaactttaaacnctagcaagtagacgggtgacgtgaggtgttaggggtttatacgtnagancgtagacgtacaaccgaacctatccacgttacggcgaacggacaccgcgtaacggaactaacgtaaacgactaggntacgtcncgtaacnctcgtactac

SEQ ID NO: 422927 - DNA, 693 bp, Homo sapiens
  misc_feature: GZ8MTXP02GVFGA.15.25.C03.1.454.CMB.2.raw
  modified_base (414)..(414): a, c, t, g, unknown or other
  modified_base (462)..(462): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctcgcccgtccaccccgtggagacgccggcctccatcctcctgcaggtctagtcagacgccctaccagcatactgatggaatactaacttagttaggacgttggtacctgacagaacgccgagggctagtcctaccaactaacctctagtacttcgtttagtttacgggtactaacggtccggggtccccggtccggggtaccccgtagtaccgtaggttccgtaggtcggacgnggtagatcggagtctaataacgttaactttaacgaacgtaaagtaaancgaacgagaaggtaggtacgggaggtacgtagggtacgggtttaacgggtttaggggtttaacttacgtagtagtacggtacgtaacgtaaaccggtacctaaacccgaaacccgtactacccgtaccggttacccgggacggaaacgggaccgtaccggtacggtaaacggtaacgtaaaaccgtaacgtaacggtcgtacggacgtacgactaacctcgttacgttacg

SEQ ID NO: 422928 - DNA, 764 bp, Homo sapiens
  misc_feature: GZ8MTXP02FG1NH.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctcgcccgtccacccgtggacgacgcccggcctccatcctcctgcgtaggttctagtcagacgccctacagctatactgagtagaataactaattagttggtagttacggtacctgacgaacgaacgaccggagggcctacgtcctaccaactacctcgtagtacttagttaggtttacggttacgtaacggtccggggtccccggtttaccggggtcccctacggtacgtacgggttacgtaggtcggacggtcggtacgggaactacggaacggtactaaagttaaacgtttaacttttaaaccgacgttaaaaggaaaacttcgaacggtacggtaaagggtacgggtagggaacgggtgttaacggggttaaacgggggtttacggggttttaggttaaacttacgtagtacgttaacggtagtaaccgtaaaccggttacccaaaacccgtaacccggtacttacccggtacccggtacgggaaccggaacgggaccttaccgggaacgttaaacgggaaaacgtttaaaacgtaaccggtacgttcggcggtaccacggacctacgtacgttactttccg

SEQ ID NO: 422929 - DNA, 649 bp, Homo sapiens
  misc_feature: GZ8MTXP02F24WV.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatcagtgggatattgtgatgactcagtctccactctccctgcccgtcaccctggagacgccgcctcatctcctgcaggtctagtcagagcctcagcatactgatggatacaacttattggtattggtacctgacagaagccagggcagtcctaccacaactcctagtatcttagtttgggttactagtcggccgtccgggtccccctgactagttcaggtggcagtgatcgagtctaagtactattttaacaactaagaaaatcgagcgaggtaggtagggaacggtgtagggtaagggttaacggggtttagggggtttaaacttaagtgagtatacggtacgaacgggttaaccttaaacccgaaaaccccgtaaactaccgtacccgtttaccggggaacccggtaacggggaaccacgggtacccgtaacggggtaaacggtaaaaccttaaaacggtaaaccttaagggtcggaccggttacgacgtaaaccctaagttcgtttccg

SEQ ID NO: 422930 - DNA, 663 bp, Homo sapiens
  misc_feature: GZ8MTXP02I0MWO.15.25.C03.1.454.CMB.2.raw
  modified_base (271)..(271): a, c, t, g, unknown or other
  modified_base (389)..(389): a, c, t, g, unknown or other
  modified_base (545)..(545): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgccccgtcacccctggagacgccggcctccattcctcctgcaggtctaggtcagacgcctccagcatactgatggattacaacttatttggnttcggtacctgacaggaagccgagggcagtcctacaacctacctctgactttacgttagttttgggtactaacgttccggggcccgttccggggtcccctgacgtggtctagtggacngtgattcgagtcaagttagtaattttacactaagaaactacgaagacgtaaggtaggtaggacggtagtagaacggggtttcggtttaagggggtttacttaacggttcgatacgttacggactaaacgggttacccctaaaccggaaaccccgtntaaccgtaccggttaccggaccggtaacgggaactcggtacccgtaggtaaacgttaacgttaaaacgtacgttcgggtacgggtacacggtacctaaccgtagtttaccctttacgg

SEQ ID NO: 422931 - DNA, 723 bp, Homo sapiens
  misc_feature: GZ8MTXP02G437Z.15.25.C03.1.454.CMB.2.raw
  modified_base (697)..(697): a, c, t, g, unknown or other
  modified_base (707)..(707): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccaccccgtggacggacggcccggcctaccacttcctccgtgcctaggtctagtcagacgcctaccagcatactgtatcggaataacacttagtttggattcggtacctgacagacgccgaggcacgtcctaccatacctctagtacttcgtttggtttacggtctaaacggtcccggggtcccggttacccggggtcccctaggtacggttacggttcgtaacggtcggtacgtggggttacgtacgtaccgtacgggaccttaaagttaacgggtttaaattttaaacccgaaagttaaaacggtaaaaccttcggaacgagtaacggggtaagggtaggggtaaacggtccgggtaaagggggttaacggggtttaacggggttttaggggttttacttacggtagggtatagggtacgtaacgaccggttaacgtaaacccaccggtactacccggtacgtacgggaccgacgacgtccgtacgaggtacgtaaacgtacggtaacngtcggtaccncgactactcgtactcg

SEQ ID NO: 422932 - DNA, 685 bp, Homo sapiens
  misc_feature: GZ8MTXP02FJMV2.15.25.C03.1.454.CMB.2.raw
  modified_base (667)..(667): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccaccccgtgggacgacgcccggccctccattcctccctgcgtaggtcttagcagacgcctccagcctatactgataggactaacaacttagttggattacggtacctgaccaagaacgccgaggcacgttccacccaactaacctcctgtacttacgtttagtttcggggtttacctaacggtcccggggtccccgttaccggggtcccccctggtaaccgtcggttcgaggttcggacgagggttggacgttaccgaggtactaaagtttacgtttaaactttttaaaccgaacgttaaacgtaaaactcgaaaggtaccgaaggtacgggttagggaaccgggtcgtaggtacggggttacgggtttagggtttaaactgtgacttagtagacgtaacggtacctaaaccgaaccctacgaccgtccgtagggacccggaggtaccaaccgtacggagaacgttaacaacgtagtcgngctacgccactcgtctcg

SEQ ID NO: 422933 - DNA, 602 bp, Homo sapiens
  misc_feature: GZ8MTXP02IC4A9.15.25.C03.1.454.CMB.2.raw
  modified_base (252)..(252): a, c, t, g, unknown or other
  modified_base (276)..(276): a, c, t, g, unknown or other
  modified_base (508)..(508): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctcctgcccgtcacccctggagagccggctccatctctgcaggtctagtcagagcctccagcatactgatgatacaatnttggattggtacctgcagacgcgnggcagtctccaacactctagacttacttagtttgggtactaagtccgggtacctccggggtacccctgaccgtggttcaggttggcaggtcgatccgagtaccgtaattagttactttaaccacgtaagtaaaactcaagacgagaggttaggacggagttagggaggttaacgggtttagggtttaaactcgtagcgtaagtacggacgtaacggtactaaccaacccgtntaccgtacggtaccggacggacggaacaccgtacgtaaggacgtaaacgttaaacgaaccgttggtcggacctagacctacgtagtcccttacg

SEQ ID NO: 422934 - DNA, 627 bp, Homo sapiens
  misc_feature: GZ8MTXP01D2R5K.52.43.D10.1.454.CMB.2.raw
  modified_base (197)..(197): a, c, t, g, unknown or other
  modified_base (302)..(302): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaaagaaatagtgatgacgcagtctccagccaccctgtctgtgtctccgaggggaancagtccaccctctcctgcagggccagtcagtactagttaaaccacctaacttagcctaggtaccagcaacaacgtggccggctcccaggcctctcatctatggtncactccacgcggccagtggtctcccagccgtaggttcaggtcggacgtaggtggggtacgtggggactaggtaacgtttcaacgttctaccaacccagtcaagcacgtccctgacctagtcgtagtaaagtttcgttttgacttaagttttctacgttgttacaggtactagtttatacacgttaacgttcggtcctttacgttaccttccggtttccgggacccgttaggggaacccgtaagggttcggaattaaccgttaacgaaaacggtcgttcggttcggttctaacgcctaactacgttcttcgtttcctttcgtaacc

SEQ ID NO: 422935 - DNA, 694 bp, Homo sapiens
  misc_feature: GZ8MTXP01AJOKN.52.43.D10.1.454.CMB.2.raw
  modified_base (197)..(197): a, c, t, g, unknown or other
  modified_base (274)..(274): a, c, t, g, unknown or other
  modified_base (283)..(283): a, c, t, g, unknown or other
  modified_base (293)..(293): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaaagaaatagtgatgacgcagtctccagccaccctgtctgtgtctccgaggggaancagtccaccctctcctgcgagggccagtcagactagttaacacctaattgcctggaccagcacaaccgtggccggcnccagcctcnatctagtgtncactccacgaggccacgtggtctcccagcctaggttcaggtcggcgtagggtgggtcgtaggggacctaggtaacgtttccaaccgttccctaccaaccctaactccgacggaccgtaccggcccgttggaccttaaacggtcgttaaaggtaaagtttacgtttttcggaacttttaaggtttttacttaccgttaggttaacgtacggtacgttaaaggttactttaccgtaaacgtttaaccggttccggggtttccctttaccgtttacccgttacccggttttcccgggaccccggttacggggaacccgtaagggtacggttaaacttaacgttaacgtaaaacggtcgttacgggcggttacctgaccctcgtatcgttacttcttaacctccg

SEQ ID NO: 422936 - DNA, 786 bp, Homo sapiens
  misc_feature: GZ8MTXP01DU899.52.43.D10.1.454.CMB.2.raw
  modified_base (197)..(197): a, c, t, g, unknown or other
  modified_base (292)..(292): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccacctgtctgtgtctccgagggggaacncacgtccacctctcctgcgacgggccagtcaagtacttacgtaaaccacctaacgttcgcctaggtaccagacaaccgaaccgtcggcccggccncccgacgtcctacctactactctagtcggtcaccactcccgaaccgacggcctacgtcggtaccgtcccgagtccgtaggttcaggtcggacgtacgggtcgggtacgtacggggaactaggtaacgttaccaaccgttcctaaccgaaccctagtaccgaacgaccgtacgtcccgtacgacgtagttacgttaaggttaagtttacgttttacgtactttaaacgtttttacttaccgttagtaacgtacgtacgttaacgttaacttaccgttaaacgtttaacccggtttccggtttaccctttccgtttacccgtttacccggtttaccccgggtaccccggttaacggggtaaacccggtaaaggggtttacgttaaacgtttaaacgttaaacccggaaaaccggttcgttccgggttacggttacccttaaccggaaccttaacccgttcgttcccgtttacgtttaaccccgtttcgtaacccgg

SEQ ID NO: 422937 - DNA, 645 bp, Homo sapiens
  misc_feature: GZ8MTXP02HU01Y.52.43.D10.1.454.CMB.2.raw
  modified_base (195)..(195): a, c, t, g, unknown or other
  modified_base (394)..(394): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccaggggaancagtccaccctctcctgcgagggccagtcagtactagttaaaccacctaacttagcctaggaccagacaacaaaccgtcggccggctcccgaggcctcctcatctagtggtcactactcccaccgacgggccctacgtcggtcgtcccgacgccgtaggttcaggtcggcgtaggtgggtcgtgggacaggtacgttcnccttctacaacctatcgacgcacgcctgacagtcgtagtaagttatttcgacttagtttattacgttgtacagtactaagttactacgtaattaaccgttcggttccttactttccgtacgtttcccggtcccgtacggggtaacccgtaacgggttacggtaaactaacgtaaaccgtaaaaccggtacgttacggtacggcgttaacggaccctaaccgttacttccgtttacgttacctttacgtacc

SEQ ID NO: 422938 - DNA, 653 bp, Homo sapiens
  misc_feature: GZ8MTXP02IM3DS.52.43.D10.1.454.CMB.2.raw
  modified_base (195)..(195): a, c, t, g, unknown or other
tcagcgcagtacgacacgaccggtgctcgatttagactagcagtaaggggaggaactgctcagttaggacccagacggaaccatggaagccccagcgcagcttctcttcctcctgctactctggctcccagattctactgaagaaatagtgatgacgcagtctccagccaccctgtctgtgtctccagggggaancagtccaccctctcctgcgagggccagtcagtacttagttaaccacctaacttagcctaggtaccagaccaaccaaaccgtcggcccggcctaccccgaggtcctccctacactctagtggtcaccactcccgaccgacgggaccctacgtcggtccgtccccgagtcccgtaggttcaggtcggacgtagggttcggggtctggggactaggtacgttcaccttctaccaacctataccgagaccacgcctgactacgtcgtagtaagttagtttcgacttagtttacttacgtgttactagtactagttatactaagttaaccgttcggttaccttcgttaccgttacgtttccggtacccgtacgggtaaccgtaacggtacgtaattaacgtaacgaaacgtacgtacgtacggtactaacgaccgtacgtactacgttcgttaccttactacg

SEQ ID NO: 422939 - DNA, 521 bp, Homo sapiens
  misc_feature: GZ8MTXP02GCFT6.52.43.D10.1.454.CMB.2.raw
  modified_base (195)..(195): a, c, t, g, unknown or other
  modified_base (293)..(293): a, c, t, g, unknown or other
  modified_base (498)..(498): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccaggggaancagtcaccctctcctgcagggccagtcagactgttaaacaccaacttagcctggtaccagcacaacctggccggctcccaggctcctcatctatggtncatccaccaggggcccacgtggtcgtccccagcccaggttcaggtggcaggtggggtctggggactaggagtttcacctctcaccatccagcagcctgctagtctgaagtattttgctagtttatacgtgtcagcagtatactagtaactggtccttacttctactttcggtcctggacctaaggtgatatacaaacgtactagnggctgcacactctcgtcttctac

SEQ ID NO: 422940 - DNA, 603 bp, Homo sapiens
  misc_feature: GZ8MTXP02JFV6T.52.43.D10.1.454.CMB.2.raw
  modified_base (197)..(197): a, c, t, g, unknown or other
  modified_base (299)..(299): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaaagaaatagtgatgacgcagtctccagccaccctgtctgtgtctccgaggggaancagtcaccctctcctgcagggccagtcagactgttaacacctaacttgcctggtaccagcaacaaacctggcccggctcccgaggcctcctcatctatggtncatccaccgagggcccacgtggtcgtccccaggccctaggttccaggtcggcagggtcgggtctggggaacaggtacgttcacttcctacacccatccagtcacgcctgctagtctagaagtatttgcttagtttattactgtacagctagttatactaattaaccgttcgggttaccccttacgtaccgtttccggtccgtacgggtaccgtaagggttcggtaagttacgtaacgtaaacggtaacgtacggtacggtactcggaaccgtacgtacttactcgttcctttacgtactttccc

SEQ ID NO: 422941 - DNA, 512 bp, Homo sapiens
  misc_feature: GZ8MTXP02GK5HD.52.43.D10.1.454.CMB.2.raw
  modified_base (195)..(195): a, c, t, g, unknown or other
  modified_base (272)..(272): a, c, t, g, unknown or other
  modified_base (283)..(283): a, c, t, g, unknown or other
  modified_base (292)..(292): a, c, t, g, unknown or other
  modified_base (340)..(340): a, c, t, g, unknown or other
  modified_base (399)..(399): a, c, t, g, unknown or other
  modified_base (427)..(427): a, c, t, g, unknown or other
  modified_base (485)..(485): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccgaggggancagtcacctctcctgcagggccagtcagactgtaacacattgcctgtaccagcacaactggccggctccaggctccncatctatggtncatccacgnggcccagtggctcccagcctaggttcagtgcaggtgggtctggggacngtagttcactctcaaccatccagcacgcctgcagtctagaagtattgctagttatactntcagctagtatacattactgggttcctnttcctacgtttccggccgttagggacctaaggtgtaatactacgaaaacgtacttggngactgaccactatctcgtacttctacc

SEQ ID NO: 422942 - DNA, 620 bp, Homo sapiens
  misc_feature: GZ8MTXP02GFLIK.52.43.D10.1.454.CMB.2.raw
  modified_base (198)..(198): a, c, t, g, unknown or other
  modified_base (303)..(303): a, c, t, g, unknown or other
  modified_base (370)..(370): a, c, t, g, unknown or other
  modified_base (379)..(379): a, c, t, g, unknown or other
  modified_base (383)..(383): a, c, t, g, unknown or other
  modified_base (387)..(387): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggcctcccagattctactgaagaaatagtgatgacgcagtctccagcccaccctgtctgtgtctccgaggggaancagtccaccctctcctgcagggccagtcagtactagttaaaccacctaacttgcctggaccagcaacaacctggcccggctcccaggcctcctcatctagtggtncatcccacgacggcctagtcggtctcccagccgtaggttcgaggtggcagggtcgggtctggggacngtacgttcnctcncacntcagcagccctgaccgtagtcgtagtaaacttgtttcggactttaagtttactacgtgttaacacggtactaagttataccgttaaagttaccggttcggtttcccttactttaccgttaaccgggtttccggtaccgggtaaacgggtaaccgttaaaagggtcgtaaataccgtaaacgaaaccggtacgttggtcgactgaccctactacttcgtacttcctactacccg

SEQ ID NO: 422943 - DNA, 608 bp, Homo sapiens
  misc_feature: GZ8MTXP02JIHBG.52.43.D10.1.454.CMB.2.raw
  modified_base (295)..(295): a, c, t, g, unknown or other
  modified_base (305)..(305): a, c, t, g, unknown or other
  modified_base (364)..(364): a, c, t, g, unknown or other
  modified_base (575)..(575): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccgaggggaagcagtcaccctctcctgcagggccagtcagactgttaacaccaattagcctggtaccagcaacaaacctggccggctcccgaggctcctcatctatggtncactccacgnggccacgtggtctcccagctaggttcagtcggcacggtggtcgtgggacaggtagttcncctctaccactacgtcacggtcaacgcctcgaccgtaagtcgtaaggaaagttattttcggattaacggttttattaccgtgttaccgagtactaagttactacgtaattaaacgtccgggtttacctactttacgtaaccgtttccgacccggttagggaacccgtaagggtacggtaatacggtaaacgtaaaacgtacgtggtacggnttaacgacctactacttcctagtttcctactcc

SEQ ID NO: 422944 - DNA, 690 bp, Homo sapiens
  misc_feature: GZ8MTXP02JQ88C.52.43.D10.1.454.CMB.2.raw
  modified_base (195)..(195): a, c, t, g, unknown or other
  modified_base (399)..(399): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccgagggaancagtccaccctctcctgcagggccagtcagactgtaaccactaacttagcctggtaccagcaacaaccgtggccggctccaggctcctcatctatgtgcactccacgcgggccacgtgggtctcccgagtccgtaggttccgaggtcggacgtagggttcgggtcgtagggaccgtagtacgtttccacttccaccacccttanacgacgacgcgtaccgtcgaccgtagttacgtaggtaaagtttacgtttacggtacttttaaggttttaacttacgtacgttacgtagtacttaacgttaacgttaccgttaacggtttaaccggttccggtttaccctttaccgtttaccgtttaccggtttacccggtaccggttaacgggaaccgttaagggttacgtaacgtaacgtaaacccgtaaacgtacgtacggtcgtaccgtaacgtacccgttaactacgtttacgtttacgtttacctttaccgtaccg

SEQ ID NO: 422945 - DNA, 627 bp, Homo sapiens
  misc_feature: GZ8MTXP02HYWFZ.52.43.D10.1.454.CMB.2.raw
  modified_base (196)..(196): a, c, t, g, unknown or other
  modified_base (252)..(252): a, c, t, g, unknown or other
  modified_base (281)..(281): a, c, t, g, unknown or other
  modified_base (292)..(292): a, c, t, g, unknown or other
  modified_base (335)..(335): a, c, t, g, unknown or other
  modified_base (364)..(364): a, c, t, g, unknown or other
  modified_base (407)..(407): a, c, t, g, unknown or other
tcagcgcagtacgacacgaccggtgctcgatttagactagcagtaagggggaggaactgctcagttaggacccagacggaaccatggaagccccagcgcagcttctcttcctcctgctactctggctcccagattctactgaagaaatagtgatgacgcagtctccagccaccctgtctgtgtctccgaggggaancagtccaccctctcctgcagggccagtcagactgttaacaccaacttgcctgaccngcaacaacctggccggctcccaggctccnatctagtggtncactccaccgacggccacgtggtctcccagccgtaggtcaggngacgtaggtgggtctgggacagtcgttcncgttctacacctatcagcacgccctgctagtcgagtaagtttnttttgactttaagttattacgtgtaccgagtacgttatactactaagttaccgttcgggttccttacgtttcctaaccgggttttcccggaccgttacgggggtaaacccttaaagggggttacgtaaaattaaccgtaaaccggtaaaaccgttaggttcgtaacgggtcctaaccgaccctaaacggtacttccttcgtttaacctttccgtaacccg

SEQ ID NO: 422946 - DNA, 524 bp, Homo sapiens
  misc_feature: GZ8MTXP01DQSWJ.9.27.C05.1.454.CMB.2.raw
  modified_base (359)..(359): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccagtggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctggggaacagngttcactctcagcatcaacagcgtgcgggctgaagtatttttgttttatatgtcctagcaggtatgtataatagtcgtctgtgtcgtcggtaccgaacgggaccgaaggtaggagtagttacgaaacgaacttagttggcgtgcaaccactacttcgtcgttctc

SEQ ID NO: 422947 - DNA, 634 bp, Homo sapiens
  misc_feature: GZ8MTXP01BDJG2.9.27.C05.1.454.CMB.2.raw
  modified_base (201)..(201): a, c, t, g, unknown or other
  modified_base (382)..(382): a, c, t, g, unknown or other
  modified_base (392)..(392): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagccctcccaggctcctcatctttgatgcatccactagggccagtggaatcccagacaggttcagtggccaggtggtctgggacaagagttcactctcagcatcaaacgngcgtggcggntagtaagtttatttttgtttttatagttgtactagtactagttagttagtaacttaacgtcgggtccttcgttgggttacgggtaaccgggttccgggaacccggtaaagggggtacccgtaaagggggttcgggtaacttacgggtaaaccgaaaaccggtaacgttgggttcgggccttacggaaccctacccgtaagtttcccgttaggtttaccctttaaccgttaaccgtttccccg

SEQ ID NO: 422948 - DNA, 532 bp, Homo sapiens
  misc_feature: GZ8MTXP01EBPDI.9.27.C05.1.454.CMB.2.raw
  modified_base (371)..(371): a, c, t, g, unknown or other
  modified_base (384)..(384): a, c, t, g, unknown or other
  modified_base (394)..(394): a, c, t, g, unknown or other
  modified_base (486)..(486): a, c, t, g, unknown or other
  modified_base (505)..(505): a, c, t, g, unknown or other
  modified_base (514)..(514): a, c, t, g, unknown or other
  modified_base (527)..(527): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgttagaagcaacttagcctggtaccaaacagagacctggccagccctcccaggctcctcatctttgatgcatccatagggccagtgaatcccagacaggttcagtggccaggtggtctggggacaagagttcactcncagcatcaaacgngcgtggcggntagtaagtttatttttgttttatattgtctagtctagttagtagaattacgtggccttgtggtcggtacgttcggacgaagggacaagggtnattgtacaaagtgtggcgnttcgcactnttctgttccttcnctccc

SEQ ID NO: 422949 - DNA, 528 bp, Homo sapiens
  misc_feature: GZ8MTXP01BGJ88.9.27.C05.1.454.CMB.2.raw
  modified_base (201)..(201): a, c, t, g, unknown or other
  modified_base (260)..(260): a, c, t, g, unknown or other
  modified_base (346)..(346): a, c, t, g, unknown or other
  modified_base (355)..(355): a, c, t, g, unknown or other
  modified_base (375)..(375): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaaanagagacctggccagccctcccaggctcctcatcttgatgcatccactagggccagtgaatcccagacaggtcagtgcaggtggtcngggacaagngttcactctcagcatcaaangcgtgcgggctgaagttatttttgtttttatattgtcagtctagtatgtataactggccttcgtgtggacgttcggccgtaaaggggccaaagggtggattggtacaaacggtactggttcggcttggccactaatctgttcttcgcttcccg

SEQ ID NO: 422950 - DNA, 536 bp, Homo sapiens
  misc_feature: GZ8MTXP01E0833.9.27.C05.1.454.CMB.2.raw
  modified_base (202)..(202): a, c, t, g, unknown or other
  modified_base (420)..(420): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagcctcccaggctcctcatctttgatgcatccactagggccagtgaatcccagacaggttcagtgccaggtggtctggggacaagagttcactctcagcatcaaacagcgtgcgggctgaagtattttgttttttatattgtctagnagtatgtataactaggctctgtggtacgttcggtcgaacgggaaccgaaggtaaggagttagtacgaaacgaaacgtagttggcgttcgcacaactctcgttcttcttaacttccc

SEQ ID NO: 422951 - DNA, 627 bp, Homo sapiens
  misc_feature: GZ8MTXP01CBIRC.9.27.C05.1.454.CMB.2.raw
  modified_base (202)..(202): a, c, t, g, unknown or other
  modified_base (383)..(383): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaaccaaacagagacctggcccagccctcccaggctcctcatcttgatgcatccactaggccagtggaatcccagacaggttcagtggccaggtgggtctgggacaagagttcactctcagcatcaacngcgtgcgggctagaagttattttttgtttttaatagttgtactaaggtctaaggttatggtaattaacgtgggtacccttcgtggttacgggtaaccgtttccgggaacccgtaaagggggaccctaaagggggttgggaacttacgggtaaaccgaaaaaccgggtaaacgtttgggttacgggcccttagggaaccctaacccgtaattccgttcgttccctttaaccgaacgtttcccccg

SEQ ID NO: 422952 - DNA, 588 bp, Homo sapiens
  misc_feature: GZ8MTXP01ANTC7.9.27.C05.1.454.CMB.2.raw
  modified_base (204)..(204): a, c, t, g, unknown or other
  modified_base (375)..(375): a, c, t, g, unknown or other
  modified_base (386)..(386): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagngccaccctctcctgtcgggccagtcagagtgttagaagcaacttagcctggtaaccaacagacgacctggccagccctcccaggctcctcatctttgatgcatccactaggccagtggaactcccagacaggttcagtggccaggtgggtctgggacaagagttcactctnagcatcaaacngcgtggcgggctagaagttatttttgtttttaatagttgtctaagtctaaggttatggtaaattaacgtcgggtaccctttcgtggtacgggttaaccgttcgggacccgaaaggggaacctaaggggtcgtaattggtaacgaaaagtacgtggttggccttaggccctaacctgttcctgttccttcgaacgtttccccg

SEQ ID NO: 422953 - DNA, 583 bp, Homo sapiens
  misc_feature: GZ8MTXP01CC1D0.9.27.C05.1.454.CMB.2.raw
  modified_base (202)..(202): a, c, t, g, unknown or other
  modified_base (379)..(379): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagagcaacttagcctggtaccaacagagacctggccagccctccaggctcctcatctttgatgcatccactagggccagtggaactcccagacaggttcagtggccaggtggtctgggacagagttcactctcagcatcaacngcgtggcggctgaagttattttttgtttttaatagtttgctagtctagttagtgtaattaacgtcggtaccttcgtggtggtaaccggttcggaccgtaaaggggcctaaagggtggtaagttggtacaaaacggtaaacttgggttacggttccttggccaaacccctgttccgttggtttacccttcgttaactttcccccg

SEQ ID NO: 422954 - DNA, 526 bp, Homo sapiens
  misc_feature: GZ8MTXP01DN4IA.9.27.C05.1.454.CMB.2.raw
  modified_base (202)..(202): a, c, t, g, unknown or other
  modified_base (382)..(382): a, c, t, g, unknown or other
  modified_base (392)..(392): a, c, t, g, unknown or other
  modified_base (400)..(400): a, c, t, g, unknown or other
  modified_base (512)..(512): a, c, t, g, unknown or other
  modified_base (516)..(516): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcgggccagtcagagtgttagaagcaacttagcctggtacccaaacagagacctggccagccctcccaggctcctcatcttgatgcatccactagggccagtggaatcccagacaggttcagtggccaggtgggtctggggacaagagttcactctcagcatcaacngcgtgcgggntgaaagtntttttgtttttatacttgtcagtctagttatcgattaacgtggccttgtggtggacgttcggaccaaaggggccaagggtgattggtaacaaagtactgttggcttgcactntctnttctcgctcc

SEQ ID NO: 422955 - DNA, 640 bp, Homo sapiens
  misc_feature: GZ8MTXP01ENW8F.9.27.C05.1.454.CMB.2.raw
  modified_base (384)..(384): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgttagaagcaacttagcctggtaaccaacagacgacctggccagccctcccaggcctcctcatctttgatgcatccatagggccagtgaactcccagacaggttcagtgcaggtggtctgggacaagagttcactctcagcatcaaacgngcgtggcggtattaggtaagttttattttttagtttttatagttgtactaagtactagttagttagtaacgttaacgtcggtccttgttgggttacgggtaccggttccgggaaccggtaaacgggggtacccgtaaaggggttaacggtaacgttacggtaaaccgttaaaacggtacgttgggttacgggttcttcggaaccctaaccgttaagtttccgttcgtttaccctttaaccgttaaccgtttccccg

SEQ ID NO: 422956 - DNA, 526 bp, Homo sapiens
  misc_feature: GZ8MTXP01A0SML.9.27.C05.1.454.CMB.2.raw
  modified_base (201)..(201): a, c, t, g, unknown or other
  modified_base (382)..(382): a, c, t, g, unknown or other
  modified_base (392)..(392): a, c, t, g, unknown or other
  modified_base (510)..(510): a, c, t, g, unknown or other
  modified_base (521)..(521): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagcctcccaggctcctcatctttgatgcatccactagggccagtggaatcccagacaggttcagtggccaggtgggtctggggacagagttcactctcagcatcaaacgngcgtggcggntagaagttatttttgtttttatattgtcagtctagtatgtaatacgtggtcctgtggtggtacgttcggaccgaaagggaccaagggtgattgtacaaacgtacgtgttgcttgcacntctgttcttcnctccg

SEQ ID NO: 422957 - DNA, 557 bp, Homo sapiens
  misc_feature: GZ8MTXP01EJLT4.9.27.C05.1.454.CMB.2.raw
  modified_base (395)..(395): a, c, t, g, unknown or other
  modified_base (405)..(405): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagcccaccctctcctggtcgggccagtcagagtgttagaagcaacttagcctggtacccaaacagacgacctggccagccctcccgaggcctcctcattctttgatgcactccacgtagggccaggtggaactcccagacaggttcagtggccaggtggctgggacaagagttcactctcagcatcaaacgngcgtggcggntagtaagtttagtttttagttttattagttgtactagtataagttagtagtaattaacgtcgtccttgtggtacggtacgtcggacgtaaggacgaagggtgagttagtaacgaaacgtcgtggcgcttgcactgtctgttctcttcgtccg

SEQ ID NO: 422958 - DNA, 621 bp, Homo sapiens
  misc_feature: GZ8MTXP01ERKH5.9.27.C05.1.454.CMB.2.raw
  modified_base (203)..(203): a, c, t, g, unknown or other
  modified_base (384)..(384): a, c, t, g, unknown or other
  modified_base (396)..(396): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccacctctcctgtcgggccagtcagagtgttagaagcaacttagcctggtaccaaacagagacctggcccagccctcccaggcctcctcattctttgatgcatccactagggccaggtggaactcccgaagacaggttcaggtggccaggtgggtctggggactaaggacgttcacttcncagcatcaaacngcgtgcgggctaggtaaagtttattttttggttttttaattagttgtacagtactaagttagtagtaagttaacgtgggacccttcgttggtacgggtacggttccggaccgtaaagggggacccgtaaaggggtgggaattcgggtaacgaaaacggtaaacgtggggttacggccttacggcctacctaagttccttggttccttaacgttaacgtttccccg

SEQ ID NO: 422959 - DNA, 541 bp, Homo sapiens
  misc_feature: GZ8MTXP01AQ0Z7.9.27.C05.1.454.CMB.2.raw
  modified_base (201)..(201): a, c, t, g, unknown or other
  modified_base (381)..(381): a, c, t, g, unknown or other
  modified_base (393)..(393): a, c, t, g, unknown or other
  modified_base (514)..(514): a, c, t, g, unknown or other
  modified_base (517)..(517): a, c, t, g, unknown or other
  modified_base (526)..(526): a, c, t, g, unknown or other
  modified_base (530)..(530): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaaacagagacctggccagccctccaggctcctcatctttgatgcatccatagggccagtggaactcccagacaggttcagtggccaggtgggtctggggacagagttcactctcagcatcaaacngcgtggcgggtntaggtaagtttagttttttagtttttaattacgttgtacagtactagttagtcgtaattaacgtggccttgtgtcggtacgttcggacgaagggaccaagggtgattgacgaaagtagtgngcngaaccactntctnttctcaactcc

SEQ ID NO: 422960 - DNA, 525 bp, Homo sapiens
  misc_feature: GZ8MTXP01BUJU1.9.27.C05.1.454.CMB.2.raw
  modified_base (393)..(393): a, c, t, g, unknown or other
  modified_base (445)..(445): a, c, t, g, unknown or other
  modified_base (511)..(511): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccacctctcctgtcgggccagtcagagtgttagaagcaacttagcctggtacccaaacagagacctggccagcctcccaggctcctcatctttgatgcatccactagggccagtggaatcccgagacaggttcaggtggccagtgggctgggacaagagttcactctcagcatcaaacagcgtgcgggntgaagttatttttgtttttatatgtcagtcagttatgattaactggccttgnggtgacgttcggacctaagggaccaaggtcggattggtacaaagtaactggttgcttgcactgtcngttctcaacgttcc

SEQ ID NO: 422961 - DNA, 631 bp, Homo sapiens
  misc_feature: GZ8MTXP01BOJXO.9.27.C05.1.454.CMB.2.raw
  modified_base (204)..(204): a, c, t, g, unknown or other
  modified_base (260)..(260): a, c, t, g, unknown or other
  modified_base (389)..(389): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgagggggaaanagccaccctctcctgtcgggccagtcagagtgtagagcaacttgcctggtaccaanagagactggccagcctccaggctcctcatctttgatgcatccacgtagggccaggtggaactcccaagactaggttcaggtggcctagggtgggtcgtgggacaagtagttcactctacagcatcaacngccgtggcgggtctaggtaagtttatttttttgtttttattagttgtactaggtactaagttagttggtaaacttaaccgtcgggtacccttgttagggttcgggtaccggtttccgggggaaccgtaaacgggggtaccgtaaagggggttggtaagttacgggtaaaccgaaaacggtaacgttggttcgggcttcggaacctacgtaactttccgtgtttccttcttaacgtttccccg

SEQ ID NO: 422962 - DNA, 625 bp, Homo sapiens
  misc_feature: GZ8MTXP01AXP5X.9.27.C05.1.454.CMB.2.raw
  modified_base (203)..(203): a, c, t, g, unknown or other
  modified_base (421)..(421): a, c, t, g, unknown or other
  modified_base (599)..(599): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagaagcaacttagcctaggtaaccaaacagagacctggccagccctccaggctcctcatctttgatgcatccacgtagggccaggtggaactcccgagacctaggttcaggtcggccaggtgggtctggggacaaggtacgttcacttcgtacagcaatacaaacgaggtccggtggccggggtnttaaggtaaagtttattttttttggttttttaatacgttggtacctaaggtacttaaggttatacggtaattaaccgtgggacccttgtggtcgggtaccgttcggacccgtaaaggggacctaaggggttcgaattggtaaaccaaacggtacgtggacggcttacgcctaaccttnttcgtcgttaccttcgttcgttcccg

SEQ ID NO: 422963 - DNA, 597 bp, Homo sapiens
  misc_feature: GZ8MTXP01CN8WM.9.27.C05.1.454.CMB.2.raw
  modified_base (203)..(203): a, c, t, g, unknown or other
  modified_base (295)..(295): a, c, t, g, unknown or other
  modified_base (349)..(349): a, c, t, g, unknown or other
  modified_base (365)..(365): a, c, t, g, unknown or other
  modified_base (379)..(379): a, c, t, g, unknown or other
  modified_base (389)..(389): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaaatggaagaaatagtaatgacgcagtctccagccgtcctgtctgtgtctcaggggaaanagccaccctctcctgtcgggccagtcagagtgttaagaagcaaacttagcctaggtaccaaacagagacctggccagcctcccaggctcctnatctttgatgcatccataggcagtgaatcccagacaggtcagtggcaggtggcngggacaggattcactntcagcatcaaacgngcgtggcggntagtaagtttattttttgttttaatacttgtactagtacttagttagtacgtaattaacgtcgtccttgtggttacggtaaccggttccggaaccgtaaaggggaaccgtaaggggtcgtaaagttacgtaaacgaaaacgtaacgttggttacgggcttcggaaccctaaccgtcgttcgtcgtttacctttccgaacgtttccccg

SEQ ID NO: 422964 - DNA, 532 bp, Homo sapiens
  misc_feature: GZ8MTXP01DP2M1.9.27.C05.1.454.CMB.2.raw
  modified_base (257)..(257): a, c, t, g, unknown or other
  modified_base (261)..(261): a, c, t, g, unknown or other
  modified_base (264)..(264): a, c, t, g, unknown or other
  modified_base (284)..(284): a, c, t, g, unknown or other
  modified_base (362)..(362): a, c, t, g, unknown or other
  modified_base (373)..(373): a, c, t, g, unknown or other
  modified_base (512)..(512): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctcgaggggaaagagccaccctctcctggtcgggccagtcagagtgtagagcaattgcctggaccaanaganacnggccagccctccaggctccncatcttgatgcatccactagggccagtgaactccgagcaggttcagtggccaggtggtctgggacaagacgttcactncagcatacaanagcgtaggcgggctagtaagttattttgtttttatagttgtctagtctagtagtgtaataactggactcgtggtcggacgttcggtaccgaaggtacgaaggtgagttagtacgaaacgtagtgttggcttcgcacctntcgtcttctcttcgttcccg

SEQ ID NO: 422965 - DNA, 601 bp, Homo sapiens
  misc_feature: GZ8MTXP01BDW56.9.27.C05.1.454.CMB.2.raw
  modified_base (203)..(203): a, c, t, g, unknown or other
  modified_base (378)..(378): a, c, t, g, unknown or other
  modified_base (390)..(390): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagaagcaacttagcctggtaacccaaacagagacctggccagccctcccaggcctcctcatctttgatgcatccacgtagggccagtggaactcccagacaggttcaggtggccaggtgggtctgggacaagagttcactcncagcatcaaacngcgtggcgggctagaagttatttttgtttttatattgtcagtctagttatggtaattaacgtggtacccttgttgggttcggtaaccggtttcgggacccgtaaagggggtacccaaaggggttgggaattagggtaaccgaaaacggtaacgttgggttcgggcttaggaaccaccgtaagttccttgttccctttcgaacgtttccccg

SEQ ID NO: 422966 - DNA, 555 bp, Homo sapiens
  misc_feature: GZ8MTXP01C7RZV.9.27.C05.1.454.CMB.2.raw
  modified_base (201)..(201): a, c, t, g, unknown or other
  modified_base (259)..(259): a, c, t, g, unknown or other
  modified_base (328)..(328): a, c, t, g, unknown or other
  modified_base (382)..(382): a, c, t, g, unknown or other
  modified_base (393)..(393): a, c, t, g, unknown or other
  modified_base (533)..(533): a, c, t, g, unknown or other
tcagtgatacgtctcacgaccggtgctcgatttagacgcgatcgaagggtttgggggaggactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaanagagacctggccagcctccaggctcctcatctttgatgcatccacgtaggccagtggaactcccagacnggttcagtggccaggtggtctggggacaaggtagttcactctacagcatcaacngcgtggcgggntgtaaagttattttttgtttttatattgtacagtactaggttatgtaatacgtcgtccttgtggtcggtacgtttcggacgtaaagggcctaaggggtggattcggtaacaaacgtagtggttcggcttgaacctacctnttctcgttcttccttcttcccg

SEQ ID NO: 422967 - DNA, 616 bp, Homo sapiens
  misc_feature: GZ8MTXP01AK7CA.9.27.C05.1.454.CMB.2.raw
  modified_base (202)..(202): a, c, t, g, unknown or other
  modified_base (261)..(261): a, c, t, g, unknown or other
  modified_base (368)..(368): a, c, t, g, unknown or other
  modified_base (392)..(392): a, c, t, g, unknown or other
  modified_base (416)..(416): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcgggccagtcagagtgttagaagcaacttagcctgggtaccaaanagacgacctggccagccctcccaggcctcctcatctttgatgcatccagtagggccaggtcggaactcccgagacaggttcagtggccaggtgggtctgggacaagngttcactctcagtcagtcaaacgngcgtggcgggtctaggtaaagttnttttttggtttttatacgttgtcagtctagttagtgaattaacgtcggtccttgtggttacgggtaaccggtttccggaccgtaaagggggaccctaaagggggttcggaacgtttggtaaaccaaaacggtaacgtgggttcgggcttcggaaccaacccgttaagttcctcggtttcttaaccgttaagtttcccccg

SEQ ID NO: 422968 - DNA, 705 bp, Homo sapiens
  misc_feature: GZ8MTXP01CIY2T.9.27.C05.1.454.CMB.2.raw
  modified_base (204)..(204): a, c, t, g, unknown or other
  modified_base (438)..(438): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctccgaaggggaaanagccaccctctcctgtcgggccagtcagagtgttaagaagctaaacttagcctaggtaacccaaacgagagacctggcccagccctcccgaggcctcctcattctttgatgctactccaacgtacggggacctaggtacggaaactccccgaaggaccgtagggtttccaaggtcggacccgtagggtggggtcgtaggggacaaggtacgttcacttcacagcaatcaaacgngtcgtggcgggtacttaaggttaaagttttagtttttttagtttttaatacgtttgtacgtagtacgttaagttagttacgtaacgttaacgtcggtccttaggtcgggttacgggttaaccggttccgggaaaccggtaaacggggtaaccgtaaaggggtcggtaacttacggtaaaccgaaaacggttacgttgggttacggttcttacgtaaccctacgttaacgttccgttcgtttacctttaaccgttaacccgtttcccg

SEQ ID NO: 422969 - DNA, 640 bp, Homo sapiens
  misc_feature: GZ8MTXP01BILV5.9.27.C05.1.454.CMB.2.raw
  modified_base (203)..(203): a, c, t, g, unknown or other
  modified_base (263)..(263): a, c, t, g, unknown or other
  modified_base (293)..(293): a, c, t, g, unknown or other
  modified_base (396)..(396): a, c, t, g, unknown or other
  modified_base (409)..(409): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtaccaaanagacgacctggccagccctccaggctcctnatctttgatgctactccacgtagggccaggtggaactcccagacgtaggttcaggtggccagggtgggtctggggacaggtagttcactctacagcatcaaanggcgtggccgggnttaggtaaagtttagttttttgtttttatagttgtacaggtctaggttatacggtaattaacgtggtcccttgtgggttacggtaaccggtttcccgggaaccggtaaacgggggaaccctaaagggggttgaacgttacggtaaccgaaaacgggtaacttggggttcgggcttacgggtaacccaacccgtaatttccggtcgtttaccctttccgaacttttcccccg

SEQ ID NO: 422970 - DNA, 703 bp, Homo sapiens
  misc_feature: GZ8MTXP01CE56Y.9.27.C05.1.454.CMB.2.raw
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgttagagcaacttagctggtaccaacagagacctggccagccctcccaggcctcctcatctttgatgcatccacgtaggggccaggtacggaactccccgaagaccgtagggtttccaaggttcgggaccctagggttcgggggtccgtaggggggaaccaaagggtacggtttccacgttctaccgagccaagtccaaaacgcggtccgggtgggccgggggacttagggtaaaggttttattttttttaggtttttttaattagtttcggtactaaggtactaggtttaagttaggtaaattaccgtcgggtccccttgttggggttacggggtaccgtttccggggaacccgtaaagggggtacccaaagggggttgtaagttacggtaaaccgaaaacgtacgtggttacggttcttcggccaacccgttaattccgttggttcccttcgttaaccgtttccccg

SEQ ID NO: 422971 - DNA, 540 bp, Homo sapiens
  misc_feature: GZ8MTXP01D4DDC.9.27.C05.1.454.CMB.2.raw
  modified_base (265)..(265): a, c, t, g, unknown or other
  modified_base (395)..(395): a, c, t, g, unknown or other
  modified_base (405)..(405): a, c, t, g, unknown or other
  modified_base (509)..(509): a, c, t, g, unknown or other
  modified_base (520)..(520): a, c, t, g, unknown or other
  modified_base (525)..(525): a, c, t, g, unknown or other
  modified_base (533)..(533): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgttagaagcaacttagcctaggtacccaaanagacgacctggccagccctcccaggcctcctcatctttgatgcatccacgtagggccagtggaactcccagacaggttcaggtgccaggtgggtctggggacaagtagttcactctacagcatacaacgngcgtgcggtntagtaagtttattttttgtttatagtgtacagtatagttatagtattacgtgccttgtgtcggtacgtcggacgaaggcgaggtgtattgtaacaagtacgtgngcacgctactntcgtnttccttcncgttccc

SEQ ID NO: 422972 - DNA, 603 bp, Homo sapiens
  misc_feature: GZ8MTXP01CZJYA.9.27.C05.1.454.CMB.2.raw
  modified_base (202)..(202): a, c, t, g, unknown or other
  modified_base (260)..(260): a, c, t, g, unknown or other
  modified_base (378)..(378): a, c, t, g, unknown or other
  modified_base (391)..(391): a, c, t, g, unknown or other
  modified_base (403)..(403): a, c, t, g, unknown or other
  modified_base (416)..(416): a, c, t, g, unknown or other
  modified_base (431)..(431): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaagngccaccctctcctgtcgggccagtcagagtgttagagcaacttagcctggtacccaanagagacctggccagccctcccaggcctcctcattctttgatgctatccacgtagggccaggtcggaactcccagacaggttcagtggccaggtgggtctggggacaagtattcactcncagcatcaaacgngcgtggcgggtnttaggtaagtttnttttttgttttattnttgtctagtactagttatagtaattacgtcggtccttggtggttacgggtaccggttcgggaaccggtaaacggggtaccgtaaaggggtcggtagttacggtaaacgaaaacgtacgtggttacggcttacggaacctaacctgttcgtcgttaccttcgttccgttcccg

SEQ ID NO: 422973 - DNA, 586 bp, Homo sapiens
  misc_feature: GZ8MTXP01CL1AK.9.27.C05.1.454.CMB.2.raw
  modified_base (202)..(202): a, c, t, g, unknown or other
  modified_base (258)..(258): a, c, t, g, unknown or other
  modified_base (381)..(381): a, c, t, g, unknown or other
  modified_base (393)..(393): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtccgggccagtcagagtgttagagcaattgcctggtaccaanagagacctggccagcctcccaggcctcctcatctttgatgcatccacgtagggccagtcggaactcccgagacctaggttcaggtggccaggtgggtcgtggggacaaggtacgttcacgtcncagcatcaaacnggcgtggcggggtcttagggtaaagttatttttttagttttttaattagtttgtcaagtctaggttatgtaattacctgggacccttgtggtcggtaccgttccgggaccgtaaaggggtaccaagggtggaattgtacgaaacgtacgtggttacggcttgaacctcctaatccgtgttccttcgcgttccc

SEQ ID NO: 422974 - DNA, 596 bp, Homo sapiens
  misc_feature: GZ8MTXP01A1T9Q.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagcccaccctctcctgtcgggccagtcagagtgttagaagcaacttagcctggtaaccaacagagacctggccagccctcccaggcctcctcatctttgatgcactccacgtagggccaggtcggaactcccagacaggttcagtggccaggtgggtctggggacagacgttcactcgtcagcatcaacagcgtggcgggtctaggtaaagtttattttttagttttttattagtttgtacagtactaagttatgtaattaaccgtggtaccttcgtggtcggtaccgtttcgggaccgtaaaggggaccgaaggggttggaagttcgtaacgaaacggtacgttggacgggcttggaaccaccgtaatcttgttccttcgttaacgtttcccc

SEQ ID NO: 422975 - DNA, 608 bp, Homo sapiens
  misc_feature: GZ8MTXP01C47OD.9.27.C05.1.454.CMB.2.raw
  modified_base (201)..(201): a, c, t, g, unknown or other
  modified_base (395)..(395): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccaggggaaangccaccctctcctgtcgggccagtcagagtgttagaagcaacttagcctggtaaccaaacagagacctggccagccctcccaggcctcctcatctttgatgcatccactagggccagtggaactcccagacaggttcagtggcaggtgggtctggggacaagagttcactcacagcatcaacagcgtggcgggntagaagttatttttgttttttatattgtctaggtactaggttataggtaattaaacgtcgggtccttgttcggtgggtaaccggtttcgggacccgtaaagggggacccgtaaaggggtggaaacgttagggtaaaccgaaaacggtaaccgtgggttacgggcttcggaaccctaaccgtaagttcctggttcctttccgaacctttccccg

SEQ ID NO: 422976 - DNA, 626 bp, Homo sapiens
  misc_feature: GZ8MTXP01CFONX.9.27.C05.1.454.CMB.2.raw
  modified_base (262)..(262): a, c, t, g, unknown or other
  modified_base (406)..(406): a, c, t, g, unknown or other
  modified_base (417)..(417): a, c, t, g, unknown or other
  modified_base (617)..(617): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttgcctggtaacccaaanagagacctggccagccctccaggctcctcatctttgatgcatccacgtagggccagtggaactcccagacaggttcagtggccaggtgggtctggggacaagtacgtttcacgttctacagcaatcaaacagcgtagccggggnttggaaagttnttttttagtttttaactagttcgtacagtctaaggttaattggtaattaaaccgtgggtcccttacgtggttacgggtaaccggtttcgggaaccccggaaagggggaccccgtaaaggggtggaagtttacggaacttaaaaacgggtacttgggacgggcttcggccaaaccctgttactttcggttccttttaaccncgttccccg

SEQ ID NO: 422977 - DNA, 580 bp, Homo sapiens
  misc_feature: GZ8MTXP01BSQZ7.9.27.C05.1.454.CMB.2.raw
  modified_base (205)..(205): a, c, t, g, unknown or other
  modified_base (266)..(266): a, c, t, g, unknown or other
  modified_base (295)..(295): a, c, t, g, unknown or other
  modified_base (349)..(349): a, c, t, g, unknown or other
  modified_base (369)..(369): a, c, t, g, unknown or other
  modified_base (383)..(383): a, c, t, g, unknown or other
  modified_base (557)..(557): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaagggggaaancgcccaccctctcctggtccgggccagtcagagtgtagaagcaacttgcctggaaccaaangagacctggccagcctcccaggcctcctnatctttgatgcatccacgtaggccagtgaactccagacagtcagtgcaggtggntgggacaagtagttcactcncagcatacaaacgngcgtggcgggtactaggtaaagtttagtttttttgtttttaatagtttcggactaagtctaagttagtagtaaattaaccgtcgggtaccttccggtggtacggtaacccggttcggaccgtaaacgggacgtaagggtgacttgtaacaaacgtgtcgttggcttagctaccnttctcgttactcttcgtttcccc

SEQ ID NO: 422978 - DNA, 551 bp, Homo sapiens
  misc_feature: GZ8MTXP01AP8QN.9.27.C05.1.454.CMB.2.raw
  modified_base (203)..(203): a, c, t, g, unknown or other
  modified_base (387)..(387): a, c, t, g, unknown or other
  modified_base (449)..(449): a, c, t, g, unknown or other
  modified_base (530)..(530): a, c, t, g, unknown or other
  modified_base (543)..(543): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagagcaacttagcctggtaccaacagagacctggccagccctcccaggctcctcatctttgatgcatccacgtgggccagtgaactcccagacaggttcaggtgccaggtgggtctggggacaaggtagttcactctcagtcatcaaagngcgtggcgggctaggaagtttatttttgtttttatattgtacagtctagtatgtaattacgnggtcctgtggtcggtacgttcggaccgaagggaccgaagggtggattggaacaaaccgtagtgttcggcttggcctacgtntcgtcgttcttcncgttcccg

SEQ ID NO: 422979 - DNA, 602 bp, Homo sapiens
  misc_feature: GZ8MTXP01DA1BI.9.27.C05.1.454.CMB.2.raw
  modified_base (203)..(203): a, c, t, g, unknown or other
  modified_base (293)..(293): a, c, t, g, unknown or other
  modified_base (332)..(332): a, c, t, g, unknown or other
  modified_base (362)..(362): a, c, t, g, unknown or other
  modified_base (386)..(386): a, c, t, g, unknown or other
  modified_base (572)..(572): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagngccaccctctcctgtcgggccagtcagagtgttagaagcaacttagcctaggtaccaaacagagacctggccagacctcccaggctcctnatctttgatgcatccactagggcagtgaactcccagacnggttcagtgccaggtggtctggggacaagngtttcactctcagccatcaaacgngcgtggcggatagtaaagtttattttttgttttattagttgtactagtatagttagtagtaacttacgtcggtccttgttcgggttacggtaccggtttcgggaaccggtaaaggggtaaccgtaaggggttaacgtaagttacggtaaacgaaaacgtagtggttacggcttacgcctaaccgtnttccgttcgttaccttcgaacgtttccccg

SEQ ID NO: 422980 - DNA, 610 bp, Homo sapiens
  misc_feature: GZ8MTXP01EN4DR.9.27.C05.1.454.CMB.2.raw
  modified_base (203)..(203): a, c, t, g, unknown or other
  modified_base (381)..(381): a, c, t, g, unknown or other
  modified_base (393)..(393): a, c, t, g, unknown or other
  modified_base (404)..(404): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctggtcggccagtcagagtgttagaagcaacttagcctaggtaccaaacagacgacctggccagccctcccaggcctcctcatctttgatgcatccacgtagggccagtggaactcccagacaggttcaggtggccaggtgggtcgtggggacaagtgttcactctnagcatcaaacgngcgtggcggtntagttaagtttattttttagtttttattagttgtactagtacgtagttagttagtaacgttaacgtcggtccttcgtggttacggtaccggttcggaaccggtaacgggaaccgtaagggtaagtaagttacggtaaaccgaaacggtacgtggttacgttcgttacgaacctacgtcttcgtcgttccttaacgttccgttcccg

SEQ ID NO: 422981 - DNA, 616 bp, Homo sapiens
  misc_feature: GZ8MTXP01BC7T0.9.27.C05.1.454.CMB.2.raw
  modified_base (203)..(203): a, c, t, g, unknown or other
  modified_base (394)..(394): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctggtcgggacagtcagagtgttagaagcaacttagcctaggtaaccaaacagacgacctggccagccctcccaggcctcctcatctttgatgcatccagtagggccagtggaactcccgagacaggttcagtggccaggtggtctggggacaagagttcactctcagcaagtcaaacngcgtggcggggtcttaggtaaagtttattttttaggttttttaatacgttgtacagtatagttagtacgtaattaacgtcgggtccctgttggtacggtaccggtttcgggaacccgtaaaggggaccctaaaggggtgggtaacttgggtaaaccaaaacggtaaacgttggttacggcttacgaacacctaagttcgtgttccttcttaacgtttccccg

SEQ ID NO: 422982 - DNA, 602 bp, Homo sapiens
  misc_feature: GZ8MTXP01C1FSG.9.27.C05.1.454.CMB.2.raw
  modified_base (203)..(203): a, c, t, g, unknown or other
  modified_base (293)..(293): a, c, t, g, unknown or other
  modified_base (393)..(393): a, c, t, g, unknown or other
  modified_base (415)..(415): a, c, t, g, unknown or other
  modified_base (430)..(430): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccacctctcctgtcgggccagtcagagtgttagaagcaaacttgcctaggtaaccaaacgagacgacctggccagcctccaggctcctnatctttgatgcactccacgtaggccagtgaactcccgagacaggttcagtggccaggtggtcgtggggacaaggtagttcacgtctacagcatacaaagngcgtggcgggctagtaacgttnttttttagttttatnttgtactagtactagttatagtaattacgtcggaccttcgtggttcggtaccggtttcgggaccgtaaaggggccgtaaagggtcgggtaattcggtaaacaaaccggtaagttgggttaacgcgttacgaaccctaacctaagttcctcgtttacttccaacgtttccccg

SEQ ID NO: 422983 - DNA, 576 bp, Homo sapiens
  misc_feature: GZ8MTXP01EHZQY.9.27.C05.1.454.CMB.2.raw
  modified_base (203)..(203): a, c, t, g, unknown or other
  modified_base (299)..(299): a, c, t, g, unknown or other
  modified_base (356)..(356): a, c, t, g, unknown or other
  modified_base (365)..(365): a, c, t, g, unknown or other
  modified_base (396)..(396): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccaggggaaangccaccctctcctgtcgggccagtcagagtgttagaagcaaacttagcctagggtaaccaaacagacgacctggcccagccctcccaggcctcctnatcttgatgcatccatagggccagtgaactcccagcaggttcagtgccaggtggtcngggacaagngttcatctacagcatcaacagcgtggcgggntagtaagtttatttttgttttttatattgtcagtacgtagttatggtaattaacgtggtaccttgtggttaggtacggttccggaccgaaaggggtaccaagggtggtaacttgggtaacaaaacggtacgtggttacggcttagcctactaagttcctgttcctttcgaacgtttcccg

SEQ ID NO: 422984 - DNA, 648 bp, Homo sapiens
  misc_feature: GZ8MTXP01A9O0Y.9.27.C05.1.454.CMB.2.raw
  modified_base (202)..(202): a, c, t, g, unknown or other
  modified_base (393)..(393): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagcccaccctctcctgtcgggccagtcagagtgttagagcaacttagcctaggtaccaacagacgacctggccagccctcccaggcctcctcatcttgatgcatccagtagggccaggtgaactcccgagacaggttcagtggcctaggtgggtctggggacaagtacgttcactctcagctatcaaacgngcgtggcgggtctaggtaaagtttatttttttgtttttaatagttgtactaaggtactaaggttattaggtaattaaccgtgggtacccttgtgggttacgggtaaccggtttcgggaacccggtaaagggggtacccgtaaagggggttcggtaagttcgggtaaacgaaaacgggtaccgttggggttacggttccgttacggaacccctaacctgttcccgttgttaccctttaaccgttaactttcccccg

SEQ ID NO: 422985 - DNA, 755 bp, Homo sapiens
  misc_feature: GZ8MTXP01DBVQ9.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctaggtaccaaacagacgacctggccagccctcccaggcctcctacattctttgattgcaatcccaacgtagggcccaggtcggaaactcccccgaaggtaccagggtttaccaaggttcgggcccgtaagggttgggggttacctaggggggaacctaaagggtacgttttccaacccgtttcctacgaaggcccaacttaccgaaaaccgtggtccggttagggcccgggggtattaagggttaaaacggtttatttttttttaggtttttttaataagtttcgtacgtaaggtctaaaggttattaggtaaactttaaaccgttcgggtcccttacgttgggtcggtaaccggtttcgggaccccgtaaaagggggcccgtaaaggggttgggaattacgggtaaccaaaaacgggtaaacctttgggttaagggttccttcgggaaccctaacccgttaattccccgttaggttcccttttaacccgaacgttttcccccgg

SEQ ID NO: 422986 - DNA, 616 bp, Homo sapiens
  misc_feature: GZ8MTXP01DHS0D.9.27.C05.1.454.CMB.2.raw
  modified_base (202)..(202): a, c, t, g, unknown or other
  modified_base (366)..(366): a, c, t, g, unknown or other
  modified_base (381)..(381): a, c, t, g, unknown or other
  modified_base (394)..(394): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgtagtctccagccgtcctgtctgtgtctccgaggggaangccacctctcctgtcggccagtcagagtgttagaagcaacttagcctggtaaccaacagagacctggccacgccctcccaggcctcctcattctttgatgcatccatcgggccagtgaactcccagacaggttcagtggcaggtgggtctgggacagtagttcnctctcagcatcaacngtcgtgccgggtntagtaagtttatttttagtttttatagttgactagtcgtaagttatagggtaaacttaacgttcggtccctttagtggttacgggtaccgtttacgggaccgtaaaggggtaccgtaaagggggttcggaaatttcgggaaacctaaaacggttacgttgggtcggccttcggacctaaccgtatttcgtcgttcctttacaacgtttccccgttaaccccg

SEQ ID NO: 422987 - DNA, 749 bp, Homo sapiens
  misc_feature: GZ8MTXP01CT46K.9.27.C05.1.454.CMB.2.raw
  modified_base (201)..(201): a, c, t, g, unknown or other
  modified_base (254)..(254): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaangccacctctcctgtcggcagtcagagtgtagagcaacttgcctaggtaccaanagacgacctggcccagcccctccgagcctcctcattcgttgatgactactcccgacgtacgggacctaggtacggaacctcccgaagtacgtacggttacgaggtcggaccgtagggtcggggtacgtaggggaactaaggtacgttcacgtctacgacgcaactacgaaacgcggtcggtaggaccggggtattaaggttaaagttttagttttttttttagtttttaaagtagtttcgtaacgtaagttacgttaaagttagttaacggtaaacgttaaccgttcgggtaccctttaggttcggggttaccggtaaacccgggtttcgggaaacccgggtaaacggggtaacccgtaagggggttcggaaacgttacggggttaaaaccaaaacccgggtttaaggtcgggttaaacggttcccgttacggtaacccctaaaccttgtttccccggttaagtttccctttaaccgttaaccgttttccccccg

SEQ ID NO: 422988 - DNA, 763 bp, Homo sapiens
  misc_feature: GZ8MTXP01BE6ON.9.27.C05.1.454.CMB.2.raw
  modified_base (206)..(206): a, c, t, g, unknown or other
  modified_base (438)..(438): a, c, t, g, unknown or other
tcagtgatacgtctcacgaccggtgctcgatttagacgcgatcgaaggggtttggggggagggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangcccaccctctcctgtccgggccagtcagagtgttaagaagctaacttagcctaggtaacccaaacagacgacctggccacgcccctcccgaggcctccctctactctttgatgcactccacgtagggccaggtacggaactcccgaagacaggttcaggtcgggtcctagggtggggtcgtaggggacctaaagggtacgttcactccgtacgagctaactacgaaaccgnggtcggtcgggaccggggtattaggtaaaggttttagtttttttaggtttttttaattacgtttgtccgtaagggttacctaaggtttaatacggttaaacgttaaaccggttcgggtaccccttggttacgggtttaccggggtaacccgggtttccggggaacccgggtaaaacgggggtaaccccgggtaaaggggttaacgggtaaagttaggtaaacccgttaaaacggtaaaccggttggggttacgggttaccgttcgggaaccctaaacccggtttaacgtttccgttccgtttacctttccgttcccgtttccccg

SEQ ID NO: 422989 - DNA, 666 bp, Homo sapiens
  misc_feature: GZ8MTXP01DRPHE.9.27.C05.1.454.CMB.2.raw
  modified_base (204)..(204): a, c, t, g, unknown or other
  modified_base (412)..(412): a, c, t, g, unknown or other
  modified_base (425)..(425): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaggggaaangcccaccctctcctggtccgggccagtcagagtgttagagcaacttagcctggtaccaaacagacgacctggccacgccctccaggcctcctcattctttgatgcatccacgtacgggccaggtcgaactcccaagactaggttcaggtcggccgtagggtcgggtcgtggggacaaggtacgttccactcgtacagccatacaaacngtcgtggcgggtntaggttaagtttattttttagtttttatagttgtactagtacgtaagttagttaggtaacttaccgtcgggtcccttgtggttcgggtaacccggttcgggaaacccggttaaagggggaaccctaaagggggtaacgtaaagtttagggtaaacccgttaaaaggtaccggttgggttacgggttcccttacggaacctaaaccctgttcttcggttcctttaaccgaacgttttccccg

SEQ ID NO: 422990 - DNA, 651 bp, Homo sapiens
  misc_feature: GZ8MTXP01CMGNH.9.27.C05.1.454.CMB.2.raw
  modified_base (203)..(203): a, c, t, g, unknown or other
  modified_base (406)..(406): a, c, t, g, unknown or other
  modified_base (424)..(424): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtaacccaaacagacgacctggaccagacctcccaggcctcctcatctttgatgcatccacgtagggccagtggaactcccagactggtcaggtggccagggtgggtctagggggactaagggtacgttcacttctcgaagcaatacaaacnggcggttgggaccgggtnttagggtaaagttttatttttttttaggttttttaatagttttacggtactaagggtcttaagggtttataggtaaattaaccgtggtacccttcgtgggttacgggtaaccgggtttccggaacccggtaaagggggtaccctaaaggggttggaattcggtaaccaaaacggtcgtggttacggcttacggccaacctgtccttagttccttcaacgtttccccg

SEQ ID NO: 422991 - DNA, 596 bp, Homo sapiens
  misc_feature: GZ8MTXP01DWS6F.9.27.C05.1.454.CMB.2.raw
  modified_base (202)..(202): a, c, t, g, unknown or other
  modified_base (410)..(410): a, c, t, g, unknown or other
  modified_base (578)..(578): a, c, t, g, unknown or other
  modified_base (583)..(583): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgtaagaagcaacttagcctaggtacccaaacagacgacctggccacgcctcccaggcctcctcattctttgatgcatccacgtagggccaggtgaactcccagactaggttcaggtcggccgaggttggggtctggggaacaaggtacgttccacttcgtacagccaatacgaaacgnggtcggtggcgggtattaggttaagttttagtttttttagtttttattagttgtacgtagtacgtaagttagtagtaacgttaacgtcgtccttgtggtacggtacggttcggaacgtaagggacgtaagggtgtagttagtaacgaaagtgtgcgcttacgctactnttctnttcttcgcttccg

SEQ ID NO: 422992 - DNA, 653 bp, Homo sapiens
  misc_feature: GZ8MTXP01AQLAY.9.27.C05.1.454.CMB.2.raw
  modified_base (203)..(203): a, c, t, g, unknown or other
  modified_base (380)..(380): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtacccaacagacgacctggccagccctcccaggcctcctcatctttgatgcatccacgtagggccaggtggaactcccagacaggttcagtgcaggtggtctggggacaagagttcactctacgngtcatacaaactagggtccgtgggcccggggtcttaggggtaaagttttacgtttttttttaggttttttaattaagttttggtactaggtaccgtaggttataggtaattaacgtcgggtccctttgtgggttcggtaaccgggttccgggaacccgaaagggggtacccctaaaggggtcgggaaactttcgggtaaaccgaaaaccggtaggttgggttccggcttggaacccctaccaatttcgtcgttctttccaacgttttcccccg

SEQ ID NO: 422993 - DNA, 576 bp, Homo sapiens
  misc_feature: GZ8MTXP01BR7F9.9.27.C05.1.454.CMB.2.raw
  modified_base (202)..(202): a, c, t, g, unknown or other
  modified_base (298)..(298): a, c, t, g, unknown or other
  modified_base (554)..(554): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggganagccacctctcctgtcgggccagtcagagtgttagaagctaacttagcctaggtaaccaaacagacgacctggcccagccctcccgaggcctcctntatctttgatgcactccacgtaggaccaggtggaactcccgagactaggttcagtggcctaggtggtcgtggggacaagacgttcactctacagctagtacaacgagtcgtggcgggcttaggtaagtttatttttagttttttatatttgactagtacttaggtataggtacttaacgtcggtactcgtggtcggacggttcggacgaaagggccaagggtcgagttagtacaaacgtatggttgcttcgcacgnttctgttactcttaacttcccg

SEQ ID NO: 422994 - DNA, 684 bp, Homo sapiens
  misc_feature: GZ8MTXP01C8AH1.9.27.C05.1.454.CMB.2.raw
  modified_base (202)..(202): a, c, t, g, unknown or other
  modified_base (265)..(265): a, c, t, g, unknown or other
  modified_base (664)..(664): a, c, t, g, unknown or other
  modified_base (675)..(675): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtctgtctgtgtctccaggggaaangccacctctcctggtcgggccagtcagagtgttagaagcaacgttagcctaggtaacccaaanagacgacccgtggacccacgcccctcccaggccttccctctattctttgattgactatcccaacgtacgggccaaggtcggaaactcccgaagacgtaggttcaggtcggcaggtgggtctaggggaacagtacgttccacttcgacgacgctaacgtaccaacgtacggtcggtagggaccgggggtattagggtttaaagtttagtttttttttagttttttaaagtagtttcggtacaggttaacgttaaggttattagtaaacgttaccgtgggtacccttgtcggttacgggtaccgtttcggaacccggtaaaggggaacccgtaaagggttcgaacgttgggtaaaccaaaacgggttagtgggttacggttcacggtaacctaactcgttntacttctttcngtttccccg

SEQ ID NO: 422995 - DNA, 684 bp, Homo sapiens
  misc_feature: GZ8MTXP01AWBYJ.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtctgtctgtgtctccgaggggaaangcccacctctcctggtcgggccagtcagagtgttaagaagcaacttagcctaggtaaccaaacagacgacctggcccagccctcccgaggtcctcctcattctttgatgcatccacgtaggccaggtcggaactcccgagtactaggttcaggtcggcctagggtgggtctaggggactaagtacgttcactctacgagctaatacgaaacgaggtcggtagggccgggtagttaaggttaaagttttagttttttttaggttttttaattagtttcgtactaaggtacttaaggttagttaaggtaacgttaaaccgttcgggtaccttcggttcgggtacgggttacccggttccgggtaacccggaaacgggggtacctaaagggggtcgtaagttaacgggtaacgaaaacggtacgttgggttcggttacttccgaactaacccgttcgttcgtcgttaccttccgttccgttcccg

SEQ ID NO: 422996 - DNA, 697 bp, Homo sapiens
  misc_feature: GZ8MTXP01B0TVH.9.27.C05.1.454.CMB.2.raw
  modified_base (204)..(204): a, c, t, g, unknown or other
  modified_base (414)..(414): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctaccgaggggaaangccaccctctcctgtccggccagtcagagtgtagagcaacttagcctaggtaccaacagacgacctggccagcccctccaggctcctctatctttgatgcactccacgtacgggccaggtacggaactcccgagacaggttcaggtggcctagggtaggtcgtaggggactaagtacgttcaccgttctacgacgtccaagtacgaaacncgggtcgtcgggaccggggtcttaagggtaaagttttagttttttttggttttttaattagtttgtacgtaagtacgtaagttagtaggtaattaaccgtcgggtacctttcggttaggtacgggttaacccgggtttacggaacccgtaaacgggggtaaacccgtaaagggggtttcggaaacgttaccgggtaaaccgttaaaaacggtaaccggttggttacgggccttacggaacctaaccctaagttccttacgttccttcgttaaccgtttccccg

SEQ ID NO: 422997 - DNA, 727 bp, Homo sapiens
  misc_feature: GZ8MTXP01DKZVG.9.27.C05.1.454.CMB.2.raw
  modified_base (204)..(204): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctaccgaggggaaangcccacctctcctggtcggccagtcagagtgtaagagctaattgcctggtaccaagagacgacctcggaccacggcccctccgacggtcctcctctattcttgatcgactactccgacgtacgggcctaaggtcggaaactcccgaagacgtacggttcaggttcggacccgtagggttggggtacgtacgggggaactaaagggtacgttccgactttccacgacgtacctaactaccgaaacgtcgggttaccgggtggggacccgggtatttaaagggttaaaagtttttagttttttttttaggttttttaaatagtttacggactaaggtacttaagttagtagttaacgttaaccgtcggtccttaggtcggtacgggttacccggttacggaaccggtaaacgggtaaccgaagggggttaactacgttacggttaaacccgaaaagtcggttcggacggttccttacggtaaccctaactcgtttacctcgttaccttccgttaacctttccccg

SEQ ID NO: 422998 - DNA, 660 bp, Homo sapiens
  misc_feature: GZ8MTXP01CML4F.9.27.C05.1.454.CMB.2.raw
  modified_base (203)..(203): a, c, t, g, unknown or other
  modified_base (260)..(260): a, c, t, g, unknown or other
  modified_base (409)..(409): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagagcaacttgcctggtaccaanagagacctggccagccctcccaggcctcctcatctttgatgcactccacgtacgggccaggtggaactccagactaggttcaggtggacctaggtggggtcgtggggacaaggagttccacttctcagcatacaacagcgtaggcgggntagtaagttattttttgttttatagttgtctagtctaagttagttgtaacgttacgtcgggtaccttcggttacgggttcgggtaaccggtttccggggacccgtaaacgggggtaacccgtaaagggggttcggtaaagttacggttaaaccgaaaaccgggttaaacgttcggggttacgggccgttacgggaacctaacccgttaagttcccgtttcggttaccttttccgttaaccgttttcccccg

SEQ ID NO: 422999 - DNA, 625 bp, Homo sapiens
  misc_feature: GZ8MTXP01DUQMP.9.27.C05.1.454.CMB.2.raw
  modified_base (204)..(204): a, c, t, g, unknown or other
  modified_base (291)..(291): a, c, t, g, unknown or other
  modified_base (361)..(361): a, c, t, g, unknown or other
  modified_base (374)..(374): a, c, t, g, unknown or other
  modified_base (378)..(378): a, c, t, g, unknown or other
  modified_base (384)..(384): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaaatggagaaatagtaatgacgcagtctccagccgtcctgtctgtgtctccgaggggaaangccacctctcctggtcggccagtcagagtgttagaagcaacttagcctggtaaccaaacagagacctggccagccctccagctcctnattcttgatgcatccagtaggcagtgactccagacagtcagtgcaggtggtctggacagtagttcactcncagcatcaaacgngcgnggcgtntagtaagtttatttttagtttatcgttgacagtactagttagttagtaacttacgtcggtaccgttgtacggttacgggtaccggttaccgggaaacgggtaaacggggtaaccgtaaggggttaacggtaacgttacggtaaaccgaaaacggtacggttcgggttacggttccgttacgaacccgttaaccgttaacgtttccgttacgtttacctttaacccgttaaccgtttccccg

SEQ ID NO: 423000 - DNA, 690 bp, Homo sapiens
  misc_feature: GZ8MTXP01AJXMV.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaancgccaccctctcctggtccgggccagtcagagtgttagaagcaacttgcctaggtaccaacgagacgacctggccacgccctccaggctcctcatctttgatgctactccacgtacgggccaggtcgaactccccgagacgtaggttacaggttggacccgtagggttggggtcgtagggggaacctaagggtacgtttccgaacctcctcgacgacctaagtaccaaacgacgggtcggttacgggcggggtacgttaggttaaagtttagttttttgttttttaattagtttgtacgtagtactaagtagtacggtaacttaacgtcgggtccttcgttggtacggtaccggttccgggaccgtaaacggggtaccgtaagggtaaggaacgttacggtaaaccgaaaacggtaacgttgggttacggccttcggaaccctaccgtaacgttccttacgttacctttcccgaacgttttcccccg

SEQ ID NO: 423001 - DNA, 686 bp, Homo sapiens
  misc_feature: GZ8MTXP01COHEG.9.27.C05.1.454.CMB.2.raw
  modified_base (450)..(450): a, c, t, g, unknown or other
tcagtgatacgtctcacgaccggtgctcgatttagacgcgatcgaagggtttggggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagcgccaccctctcctgtcgggccagtcagagtgtagaagcaacttagcctggtaaccaagagacgacctggccacgcccctcccaggcctcctctattcttgatgcactccacgtacgggccaggtacggaactcccgaagactaggttcagtcggccgtaggtgggtcgtaggggacaaagggtacttcacgttctacgagcaataccgaaacgcggcggtaggccggggtattaggtaaagtttntttttttagtttttaatagtttcgactaggtacttaagttagtggtaaacttaccgttcgggccctttggtcggggttcgggttaaccggtccggtacccggtaaaagggggtacccaagggggttcgtaaacgttcgggttaaaccaaaccgggttaacgtgggttacgggttccttaccgggtaacctaaccctttgttacccgtttcggttacctttaaccgcttttcccccg

SEQ ID NO: 423002 - DNA, 600 bp, Homo sapiens
  misc_feature: GZ8MTXP01CLXXS.9.27.C05.1.454.CMB.2.raw
  modified_base (201)..(201): a, c, t, g, unknown or other
  modified_base (389)..(389): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagagcaacttagcctggtaaccaacagagacctggccagccctcccaggcctcctcatctttgatgcatccacgtagggccagtcggaatccccagacaggttcagtggccaggtgggtctggggacaaggcgttcactctcagccaatcaaacngcgtggacgggctaggtaagttattttttgtttttatattgtctaagtctaagttatgtaattaacgtgggtccttcgtggttggaccggttccgggaccgtaaaggggtaccctaaggggtcggtaattcgggtaacaaacgggtaaacttgggttacggcttacggaaccacccttaagttccgttgttcccttcttaacgtttccccg

SEQ ID NO: 423003 - DNA, 736 bp, Homo sapiens
  misc_feature: GZ8MTXP01EGM2X.9.27.C05.1.454.CMB.2.raw
  modified_base (261)..(261): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtctgtctgtgtctccgaggggaagcgccaccctctcctggtcggccagtcagagtgtaagagcaacttgcctaggtaaccaanagacgaccgtggacccacggcccctcccgaggtccctcctactacttctttgactcgacctactcccgaacgtacggggacctagggtacggaactccccgaagtaccgtacgggttcaggtcggccgtagggttcggggtcgtaggggaactaagggtacgtttccaacttcctacgacggacctaacgtaccgaaacgtcggtcgggttacgggcgggggtacttaagggttaaagtttttagtttttttttagttttttaattagttcgtactaaggtcttaaggttagttagtaaacttaaccgtggtccttggttacgggtacgggttaaccggttccgggaaaccggtaaacggggtaccgtaaggggtaacgtaagttacggtaaaccgttaaaacggtacgtggggttcggcttaccggccctaacgtaacttccttaggttccctttaaccgttaacctttccccg

SEQ ID NO: 423004 - DNA, 686 bp, Homo sapiens
  misc_feature: GZ8MTXP01CMPPG.9.27.C05.1.454.CMB.2.raw
  modified_base (204)..(204): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaggggaaancgccaccctctcctgtccgggccagtcagagtgttagaagcaacttagcctggtaaccaacagagacctggccagccctcccaggcctcctcattctttagatgcactccacgtacgggcaggtgaactcccagtacgaggttcgagtggccgaggtgggtcgtaggggacaaggtacttccgactcctcgagacactacaaacgacggtcggtaggacggggtacttaggttaaagtttatttttttttggttttaactttagttggtactagtcgtaagttaggtgtaaacgttacgtcggtcctagttcggtacggtaccggttaccgggacccgtaaagggggtaccgtaaaggggttcgggtaacgttacgggtaaaccaaaaccgggttaaacggtggggttacgggttccttacgaaccccgtaacccgttaagttcctttacggttcctttaaccttaacccgttttcccccgg

SEQ ID NO: 423005 - DNA, 647 bp, Homo sapiens
  misc_feature: GZ8MTXP01EHUMH.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagagcaacttagcctggtaccaacagacgacctggccagccctcccaggcctcctcatctttgatgcatccactagggccagtgaactcccagacgaggttcagtggccaggtgggtctggggacaagacgttcactctcagcatcaacagcgtggcgggtctagtaagtttatttttgtttttaactagtttgtactagtactaaggttatggtaaacttaacgtcgggtaccttcgttgggttacgggtaacccggtttcgggaaccccgtaaagggggtacccgtaaaggggttgggtaacgttacgggttaaacccgaaaaccggtaaacgttgggttacgggccttacgggaaccctaacccgtaatttccggttcgtttacctttaaccttaacgttttcccccg

SEQ ID NO: 423006 - DNA, 669 bp, Homo sapiens
  misc_feature: GZ8MTXP01D1GK8.9.27.C05.1.454.CMB.2.raw
  modified_base (203)..(203): a, c, t, g, unknown or other
  modified_base (412)..(412): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaagngccaccctctcctgtccggccagtcagagtgtagagcaacttagcctaggtaccaaacagacgacctggcccagccctccgagcctcctcattctttgatgctactccgacgtagggccctaggtggaactcccagacgtaggttcaggtcggtccagggtgggtccgtagggacctaaggtacgttcactcgtacagcatacaaacgngtcgtggacggtattaggttaaagtttttattttttcgtttaatagtcgtacagttacgttaagttacgttacgtaacgttaacgtcggtccttggtgggttaccggtaaccgggttaccggaaacggtaaacggggtaaccgggtaaggttaacggaacgttacggtaaaccgttaaaacggtcgttgggttacgccttacgaaccctaacgttaacttccggttacgttcctttaaccgttaacccgttttcccg

SEQ ID NO: 423007 - DNA, 659 bp, Homo sapiens
  misc_feature: GZ8MTXP01DD08J.9.27.C05.1.454.CMB.2.raw
  modified_base (203)..(203): a, c, t, g, unknown or other
  modified_base (412)..(412): a, c, t, g, unknown or other
  modified_base (429)..(429): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagcccaccctctcctgtccgggccagtcagagtgttagagcaacttagcctggtaccaaacagagacctggccagccctccaggcctcctctattctttgatgcactccacgtacgggccaggtggaactcccgagactaggttcaggtcggccgaggttgggtcgtaggggactaaggtacgttcactctacagaccagtacaaacgnggtcggtggccggggtnttaggttaaggtttatttttttaggttttttaactagttgtacgaagtagtaagttagttagtaacgttaacgttcggtccttacgttggtacggggttaacccgttcgggaacccgaaaaggggtaccgtaaaggggttcgacttacggtaaaccgttaaaacggtcgttggttacggcttacggaaccctaaccgttgttccgttcgttaccttcgaaccgtttcccg

SEQ ID NO: 423008 - DNA, 642 bp, Homo sapiens
  misc_feature: GZ8MTXP01B5L0Z.9.27.C05.1.454.CMB.2.raw
  modified_base (203)..(203): a, c, t, g, unknown or other
  modified_base (399)..(399): a, c, t, g, unknown or other
  modified_base (412)..(412): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagaagctaacttagcctaggtaccaacagacgacctggccagccctcccaggcctcctcattctttgatgctactccacgtagggcccaggtcggaactcccagactaggttcaggtggccaggtgggtcgtgggacaagtacgttcactctcagcatcaaanggcgtggcgggtntagtaagttttatttttttagttattgtctagtacgtagttagttaggattaacgtacgtccgttcgttcggtcgggtacggtttaccgggaccgtaaacggggtaccggtaaacgggttacggggtaagttaacggttaaccggaaaccgttaacgttacgggttgggttaccgcggttacctaaccctactcgtttacgtccgtttaccctaactttcccgttccccg

SEQ ID NO: 423009 - DNA, 569 bp, Homo sapiens
  misc_feature: GZ8MTXP01EG192.9.27.C05.1.454.CMB.2.raw
  modified_base (203)..(203): a, c, t, g, unknown or other
  modified_base (380)..(380): a, c, t, g, unknown or other
  modified_base (392)..(392): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgttagaagcaaacttgcctggtacccaaacagacgacctggcccagcccctcccaggcctcctcatctttgatgcatccactaggcagtgactccagcagttcagtgcaggtggctgggacagagttcactctcagcagtcaaaccgngcgtggcgggtntaggtaagttttattttttagttttatgttgtacagtactagttatagtaactacgtcggccttgtggtcggtacggttccggaaccgtaagggaccgtaagggtgaacgttcgtaaacgaaacggtagttgggcgttcttacgaaccactaagttctcgttcttcttaacgttccc

SEQ ID NO: 423010 - DNA, 724 bp, Homo sapiens
  misc_feature: GZ8MTXP01CMMII.9.27.C05.1.454.CMB.2.raw
  modified_base (203)..(203): a, c, t, g, unknown or other
  modified_base (703)..(703): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaancgcccaccctctcctggtcgggccagtcagagtgttagaagctaattgcctaggtaacccaagagacgacctggacccacgcccctccgaggtcctcctcattcttgatgctactcccaacgtacgggcctaggtaggaacctcccgaaggactagggttcaggtggcctagggttgggtcgtaggggacaaggtacgttcaactctacgacgactaacgtacaaacgtcggcggtcgggacggggttacttagggttaaagtttttaagtttttttttcggttttttaaattagtttacggtacgtaaggttacgttaaaggtttaagttacggttaaactttaaccggtcgggtacccttttggtaggggttaccgggttaacccgggtttaacgggacccggtaaaagggggtacccgtaaggggttcggaaattaccgggtaaacgaaaacggtacgtgggttacggccttaggaacccctaaccttgtttccgtnttaccttccgttcgttccccg

SEQ ID NO: 423011 - DNA, 637 bp, Homo sapiens
  misc_feature: GZ8MTXP01D5AYR.9.27.C05.1.454.CMB.2.raw
  modified_base (203)..(203): a, c, t, g, unknown or other
  modified_base (211)..(211): a, c, t, g, unknown or other
  modified_base (403)..(403): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccacctntcctggtcggccagtcagagtgtagagcaacttagcctaggtaacccaaacagacgacctggacccagccctcccaggcctcctcatctttgatgcatccacgtaggccagtcggaactcccagactaggttcaggtggcctaggtggtctggggactaaggtacgttcacttcgtcagtcaatcaaaacgnggccggttaggccgggggtacttaggtaaagtttagttttttttgtttttaatagttgtacaggtactaaggttatagtaagttaaacgtcgggtaccttcgtggtacgggtaaccggtttcggaccgtaaaggggtaccgtaaaggggtcggtaagttacggttaacgaaacggtaacgtgggttcggcttaggcctaactaacgttctcggttaccttccgaactttccccg

SEQ ID NO: 423012 - DNA, 654 bp, Homo sapiens
  misc_feature: GZ8MTXP01C1TWU.9.27.C05.1.454.CMB.2.raw
  modified_base (205)..(205): a, c, t, g, unknown or other
  modified_base (440)..(440): a, c, t, g, unknown or other
  modified_base (443)..(443): a, c, t, g, unknown or other
  modified_base (451)..(451): a, c, t, g, unknown or other
  modified_base (461)..(461): a, c, t, g, unknown or other
  modified_base (482)..(482): a, c, t, g, unknown or other
  modified_base (618)..(618): a, c, t, g, unknown or other
  modified_base (627)..(627): a, c, t, g, unknown or other
  modified_base (634)..(634): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggcctcccagatatcaatggaagaaatagtaatgacgcagtctccagccgtctgtctgtgtctaccgaaggggaancgccaccctctccgtggtcggccagtcagtagtgttaagagctaacgttcgcctaggtaaccaaacgagacgaccgtcggacccacgcccctacccgacggtcctcctctacttctttgatcgactacgtccacgtacggacctaggtacgaaccttacccgaaggtacgtaggttcagggtcggcccgtaggggtcgggtcgtagggacctaaagggtcttccacgtctacgancanacaagcgngtggacggtnttagtaagttttagttttttnttttagtacttgactagtagttaagtacggtagtaacgttacggtcgtcctttacggtgggtaaccggtaccgttacggaacggtaaaggtacgaaggttggacttaacggaaacgaaacgtagtcggcgttacgntaacccatnttacgtnttaccgttcaacgtttcccc

SEQ ID NO: 423013 - DNA, 729 bp, Homo sapiens
  misc_feature: GZ8MTXP01A3BLP.9.27.C05.1.454.CMB.2.raw
  modified_base (207)..(207): a, c, t, g, unknown or other
  modified_base (264)..(264): a, c, t, g, unknown or other
  modified_base (439)..(439): a, c, t, g, unknown or other
tcagtgatacgtctcacgaccggtgctcgatttagacgcgatcgaaggggtttggggggagggaactgctcagttaggacccagacggaaccatggaagccccagcgcagcttctcttcctcctgctactctggctcccagatatcaatggagaaatagtaatgacgcagtctccagccgtcctgtctgtcgtctccgaggggaaangcccacctctcctgtcgggccagtcagagtgtagagctaactagctaggtaaccaanagacgacctggcccacgcccctcccgaggtcctcctcgtacttcttagactcgaccacgttcccaacggtacggggtacccaggtacggtaaaccctccccgaaaggtaccgtagggttcgaggtcggtcgaggggttgggtcgtaggggactaagggttacttcgactaccgtnacgactacgtacaaacgcgtcggcggacgggtagttaggttaaagtttttagtttttagttttttatagtttacgtacgtagttacgttagttaagtacggttaacttaaccggtcggttccgttcggttcggttaccggggttaaccgggttcccgggtaaaccggtaacggggtaccggttaaagggggtcgtaacgggtttacgaaaccggttaaacggacgttgggttacgggttccttacgtaaccaacccgtttctccgttcttacccgttccgttccgttccc

SEQ ID NO: 423014 - DNA, 614 bp, Homo sapiens
  misc_feature: GZ8MTXP01DHW71.9.27.C05.1.454.CMB.2.raw
  modified_base (178)..(178): a, c, t, g, unknown or other
  modified_base (201)..(201): a, c, t, g, unknown or other
  modified_base (256)..(256): a, c, t, g, unknown or other
  modified_base (262)..(262): a, c, t, g, unknown or other
  modified_base (281)..(281): a, c, t, g, unknown or other
  modified_base (415)..(415): a, c, t, g, unknown or other
  modified_base (421)..(421): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtnatgtctgtgtctcgaagggaaancgccaccctctctggtcggcagtcagagtgtagagctaattgcctaggtaccaangagacngccagccctccagcctctnatcttgatgcatcccaagtgggacctagtacgggaaactccccgaaagtaccgtaggttacacggttggaccgtagggtgggtccgtaggggaaacctaggtaacgttcacctactcgagcctaatcaaacggngtcggnggcggtacgtagtaagtttagttttagttttattagttgtacgtagtagtaggtatagtaacgtaacgtacgtcgtcgtcggtacggtacggtacggtacggtaacgggaacggtaacggtagttagtacgttaacgtaaacgtaacgttacgttcgttcgtaacgacgtaactctcgttcgttcgttcgtcg

SEQ ID NO: 423015 - DNA, 695 bp, Homo sapiens
  misc_feature: GZ8MTXP01DJQMU.9.27.C05.1.454.CMB.2.raw
  modified_base (204)..(204): a, c, t, g, unknown or other
  modified_base (303)..(303): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaaatgacgcagtctccagccgtcctgtctgtgtctccgaggggaaangccacctctcctgtcggccagtcagagtgttagagcaacttagcctagggtaacccaaacgagacaccgtggcccaaggccctcccgaggtcctcctanactttctttagatgccactccgacgttacgggcctaggtacggaactccccgaaggaacgtacgggtttccagggtcggtccgtagggttcggggtgtacgggactaaggtacgtttcactcctacagtcatacgaacgcgtcgtggccggtattaggttaagtttattttttaggtttttattaagttcggtactagtactaaggttataacgtaagttaaccgtcggtacctttcggtggttcgggtaaccggtttccggaacggtaaacgggtaaccggtaaaggggttcgtaacgttaaggttaaaccgaaaacgttacggtcggttacggttcttacggaacccttaaacgtcgttcctcgttactttaaccgttaacctttccccg

SEQ ID NO: 423016 - DNA, 774 bp, Homo sapiens
  misc_feature: GZ8MTXP01CLKA4.9.27.C05.1.454.CMB.2.raw
  modified_base (201)..(201): a, c, t, g, unknown or other
  modified_base (228)..(228): a, c, t, g, unknown or other
  modified_base (468)..(468): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtctgtctgtgtctcgaggggaaangccaccctctctgtcgggccagtcagngtagttagaagcaaacgttagccctaggtaacccaaagacggagaccctggccctagcccctccgaggccctcctcgaattccgtttgaattggacctataccccacgttaacggcctaaggttcggaaactttacccccgaaggtaactacgggtttacgaaacgggttcggacccccgaaggttgggggtccgttagggggaaaccaaaccgggtagtttcccaactttacccgtaanaccggtactacgttacgaaaccgtggtccggtaggtacggtaggttaggttaaacgttttagttttttacgtttttaagttacgttacgtacgtaacggtcgttaaagttacggttaacgtaaagtttaaacgtccggttaccgttcggtacggttaccgggttaccggttccgggtaaaccggtaaacggggaacccgtaaggggtaacgtacgttacggtaaacaaaccggttaacgtcgggttacggccttacgaaacctccgttaacttcgttacgttccgtttaaccgttaaccgttcccg

SEQ ID NO: 423017 - DNA, 697 bp, Homo sapiens
  misc_feature: GZ8MTXP01BCG0Z.9.27.C05.1.454.CMB.2.raw
  modified_base (205)..(205): a, c, t, g, unknown or other
  modified_base (280)..(280): a, c, t, g, unknown or other
  modified_base (326)..(326): a, c, t, g, unknown or other
  modified_base (365)..(365): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaaggggaaanacgcccaccctctccgtggtccgggccagtcgagtagtgttaagaagtcaacttaggcccttaggtaacccaaanagacgtaccgtggcccagccctcccgaggcctacctcatctttagntgcactccgacgtggaccaggtcgactcccgaagtacgnggttacgaggtggcccgtaggtggggttcgagggggaccaaggtacgtttccaacttcctacggacacctaacaaccgaacgtcggtccggtacggacgggttacgttaaggtttaacgttttttagtttttttaagtttttaattacgttacgaccgttaagtacgttaagtacggttagtaaccgttacgtcgggttccttgggttaggtacgggtaccggtaccgggtaacggaacgggtacgagggtaagtaacgttacggaaacgttaacgtagttcggcggccttacgaaccctacgtcttcggttattccgtccgttccgtcccg

SEQ ID NO: 423018 - DNA, 597 bp, Homo sapiens
  misc_feature: GZ8MTXP01CQX8D.9.27.C05.1.454.CMB.2.raw
  modified_base (202)..(202): a, c, t, g, unknown or other
  modified_base (260)..(260): a, c, t, g, unknown or other
  modified_base (399)..(399): a, c, t, g, unknown or other
  modified_base (570)..(570): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctggtcgggccagtcagagtgttagagcaacttagcctggtaccaanagagacctggccagccctcccaggcctcctcatctttgatgcatccacgtagggccaggtcggaactcccgagtacaggttcaggtggcccgtaggtggggtctggggacaaggtacgttcacgtctcgagcatcaacngcgtggcgggtactaggtaagtttctttttttgtttttatagtttcgtacagtcgtaagttagtgaattaccgtgggccttcgtggtacgggtaccgttcggaccgtaagggaccctagggtgtattacggtacaaacggtacgtggacggttccttaggcctaaaccgtnttccgtcgttccttcaacgtttccccg

SEQ ID NO: 423019 - DNA, 522 bp, Homo sapiens
  misc_feature: GZ8MTXP02J21G5.9.27.C05.1.454.CMB.2.raw
  modified_base (202)..(202): a, c, t, g, unknown or other
  modified_base (365)..(365): a, c, t, g, unknown or other
  modified_base (374)..(374): a, c, t, g, unknown or other
  modified_base (387)..(387): a, c, t, g, unknown or other
  modified_base (396)..(396): a, c, t, g, unknown or other
  modified_base (406)..(406): a, c, t, g, unknown or other
  modified_base (434)..(434): a, c, t, g, unknown or other
  modified_base (511)..(511): a, c, t, g, unknown or other
  modified_base (521)..(521): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcatgtctgtgtctccaggggaaangccaccctctcctgtcgggccagtcagagtgttagagcaaacttagcctggtaacccaacagacgacctggcccagcccctcccaggctcctcatctttgatgcatccatagggccagtggaatcccagacaggttcagtcggcagtgggtctggggacaggngttcactcncagcatcaaacgngcgtgcggntagtagtttntttttgttttatagttgtcagtctagtntgtaatacgtgccttgtggtcggtacggttcgaccgaagggactaagggtgatcgacaaacgacgtgtgctgcactntctcgtctcnc

SEQ ID NO: 423020 - DNA, 547 bp, Homo sapiens
  misc_feature: GZ8MTXP02FL812.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggcccagccctcccaggcctcctcatctttgatgcatccataggccagtggaatcccagacaggtcagtgccagtggtctgggacagagttcactctcagcatcaacagcgtgcgggctgaagttattttgtttttatattgtacagtctagtatgattaacgtggtcctcgtggtcggtacgtttcggaccgtaaaggggacctaagggtcggatggtaacgaaaacggtaacgtggtcggctaggctaaccattcgtgttccttacacgtcccccg

SEQ ID NO: 423021 - DNA, 605 bp, Homo sapiens
  misc_feature: GZ8MTXP02IT3FS.9.27.C05.1.454.CMB.2.raw
  modified_base (203)..(203): a, c, t, g, unknown or other
  modified_base (396)..(396): a, c, t, g, unknown or other
  modified_base (420)..(420): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgttagaagcaacttagcctggtaccaacagagacctggcccagccctcccaggcctcctcattctttgatgcatccaacgtagggccaggtggaaactcccgagacaggttcaggtggccaggtgggtctggggacaggagttcacttctcagcaatcaaacgngcgtggcgggcttaggaaagtttnttttttgtttttaatagtttgacagtactaagttatagtaataacgtggcccttgtggtcggtaccggttcggacccgtaaagggggacctaaaggggttcggaagttcggtaaaccgaaaacggtaacgttcggtaggcctaggaacctaacctacgttcgttacgtccttactacctttcccg

SEQ ID NO: 423022 - DNA, 666 bp, Homo sapiens
  misc_feature: GZ8MTXP02IJUNV.9.27.C05.1.454.CMB.2.raw
  modified_base (204)..(204): a, c, t, g, unknown or other
  modified_base (213)..(213): a, c, t, g, unknown or other
  modified_base (217)..(217): a, c, t, g, unknown or other
  modified_base (331)..(331): a, c, t, g, unknown or other
  modified_base (354)..(354): a, c, t, g, unknown or other
  modified_base (379)..(379): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagngccaccctntccngtcgggccagtcagagtgttagaagcaacttagcctggtaccaacagagacctggccagcctccaggcctcctcatcttgatgcatccacgtaggccagtggaactcccagacnggtcagtgcagtggtctgggacngagttcactctcagcatacaaacgngcgtaggcgggactaggtaaagtttattttttttaggttttttaatagtttacgtacgtagttacgtaaaggtttatacggtaatttaaccgttgggtacccctttgttacggggttcggggtaaccggttttccggggaacccggtaaaagggggtaccctaaaagggggtttggaaacgtttacggtaaccgaaaaaaccgggtaccgtttggggtaacggggtcctacgggaacctaaccccgtaagtttccgttacggtttccctttacgtaactttcccccg

SEQ ID NO: 423023 - DNA, 577 bp, Homo sapiens
  misc_feature: GZ8MTXP02F9062.9.27.C05.1.454.CMB.2.raw
  modified_base (202)..(202): a, c, t, g, unknown or other
  modified_base (387)..(387): a, c, t, g, unknown or other
  modified_base (397)..(397): a, c, t, g, unknown or other
  modified_base (405)..(405): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaccaacagagacctggccagcctccaggcctcctcatctttgatgcatccacgtagggccaggtggaaactcccgagacaggttcaggtggccaggtgggtctggggacagagttcactctcagcatcaacngcgtgcgggntgaagttntttttgtttttattattgtcagtctagttatgtaataacgtgggtaccttcgtggtcgggtacgtttcggaccgtaaagggggacctaaaggggtcggaattcggtaacgaaaacggacgttgggtacggccttagaaccgtacctattcgtgttccttactacgtttcccc

SEQ ID NO: 423024 - DNA, 544 bp, Homo sapiens
  misc_feature: GZ8MTXP02F1O69.9.27.C05.1.454.CMB.2.raw
  modified_base (202)..(202): a, c, t, g, unknown or other
  modified_base (260)..(260): a, c, t, g, unknown or other
  modified_base (378)..(378): a, c, t, g, unknown or other
  modified_base (388)..(388): a, c, t, g, unknown or other
  modified_base (396)..(396): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaanagagacctggccagccctccaggctcctcatctttgatgcatccactagggccagtggaatcccagacaggttcagtgccagtgggtctgggacagagttcactctcagcatcaaacngcgtgcgggntgaagttnttttgtttttatattgtcagtctagtatgtataacgttggaccttcgtgtggacgttcggaccgaaaggggccaaagggtggatggtacaaaacggtacttggtacggcttaggccaaccgtattccgtgttcctttacactttcccg

SEQ ID NO: 423025 - DNA, 581 bp, Homo sapiens
  misc_feature: GZ8MTXP02HISFN.9.27.C05.1.454.CMB.2.raw
  modified_base (201)..(201): a, c, t, g, unknown or other
  modified_base (256)..(256): a, c, t, g, unknown or other
  modified_base (397)..(397): a, c, t, g, unknown or other
  modified_base (407)..(407): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgagggaangccacctctcctgtcgggccagtcagagtgtagaagcaacttgcctggtaccaanagagacctggccagccctccaggcctcctcatctttgatgcatccacgtacgggcctaggtcggaactcccgagacctaggttcaggtgcccgaggtgggtctaggggacaggtacgttcactctacgagcatacaaacgngcgtggcggntagtaagtttagtttttagttttattagttgtactagtactagttatagtaatacgtcgtcctgtgtacggtacggtcggaccgtaagggacgtaggtacgtacttaacgaaacgtagttggtcgtctacgacctaacgtacttcgttacgttccttactactttcccgtcccg

SEQ ID NO: 423026 - DNA, 585 bp, Homo sapiens
  misc_feature: GZ8MTXP02H3EJ6.9.27.C05.1.454.CMB.2.raw
  modified_base (203)..(203): a, c, t, g, unknown or other
  modified_base (258)..(258): a, c, t, g, unknown or other
  modified_base (288)..(288): a, c, t, g, unknown or other
  modified_base (348)..(348): a, c, t, g, unknown or other
  modified_base (368)..(368): a, c, t, g, unknown or other
  modified_base (381)..(381): a, c, t, g, unknown or other
  modified_base (391)..(391): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaagngcccaccctctcctgtcgggccagtcagagtgtagagcaattagcctggaccaanagagacctggccagcctcccaggcctcctnatctttgatgcatccactaggccaggtgaatcccagacaggttcagtgccaggtgggtcnggggacaggagttcacttcncagcatcaaacgngcgtggcggntaggtaagtttattttttagttttaattacgtgtacagtactagttatacgtaataacgtcggtccttggtaggtcgggtaccgttcgggaaccgtaaaggggtaaccgtaaagggtcggaagttacggtaaacgaaacggtacgtggtacggtctacgaacctaacgtactcgtcgttcttaccgtactcccg

SEQ ID NO: 423027 - DNA, 579 bp, Homo sapiens
  misc_feature: GZ8MTXP02IAJ1X.9.27.C05.1.454.CMB.2.raw
  modified_base (350)..(350): a, c, t, g, unknown or other
  modified_base (381)..(381): a, c, t, g, unknown or other
  modified_base (385)..(385): a, c, t, g, unknown or other
  modified_base (391)..(391): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagcccaccctctcctgtcgggccagtcagagtgttagaagcaacttagcctggtaccaacagagacctggccagcctcccaggctcctcatctttgatgcatccactaggccagtggaactcccagacaggttcagtgcagtgggtcngggacaggagttcactctcagcatcaaacgngcgngcggtntagtaagtttatttttgtttttatagttgtacagtctagttatagtaattacgtcggtccttgtggtacggtacgttccggaccggaagggaccgtaagggtggtaagttacggtaaaccgaaaacggtacgttggtacggtctacgtaacctacgtacttcgtacgtttccttacgtaccttccccg

SEQ ID NO: 423028 - DNA, 528 bp, Homo sapiens
  misc_feature: GZ8MTXP02J0415.9.27.C05.1.454.CMB.2.raw
  modified_base (203)..(203): a, c, t, g, unknown or other
  modified_base (291)..(291): a, c, t, g, unknown or other
  modified_base (378)..(378): a, c, t, g, unknown or other
  modified_base (389)..(389): a, c, t, g, unknown or other
  modified_base (398)..(398): a, c, t, g, unknown or other
  modified_base (512)..(512): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagngccaccctctcctgtcgggccagtcagagtgttagaagcaacttagcctggtaccaacagagacctggccagcctcccaggcctcctnatctttgatgcatccataggccagtggaatcccagacaggttcagtgcagtgggtctggggacagagttcactctcagcatcaaacngcgtggcgggntagaagttntttttgttttattattgtacagtctagtatgatactggacctgtggtcggtacgttcggacgtaaagggaccgtaaggtcggatggtacaaacggtacgtgtcggactgcaccngtctgtcttcacttcc

SEQ ID NO: 423029 - DNA, 551 bp, Homo sapiens
  misc_feature: GZ8MTXP02G442U.9.27.C05.1.454.CMB.2.raw
  modified_base (202)..(202): a, c, t, g, unknown or other
  modified_base (377)..(377): a, c, t, g, unknown or other
  modified_base (393)..(393): a, c, t, g, unknown or other
  modified_base (538)..(538): a, c, t, g, unknown or other
  modified_base (542)..(542): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaacagagacctggccagccctcccaggcctcctcatctttgatgcatccacgtaggccagtgaactccagacaggttcaggtggccaggtgggtctggggacaggtacgttcaccccttnacagcataccaaacgnggtcggtggcggggtataggtaaagttttattttttgtttttaattagtttgtactagtactagttatagtaattacgtggccttgtggtcggtacgtcggacgaagggcaagggtcgatcgacaaacgcgtgcgctgaacactntctntctcactcc

SEQ ID NO: 423030 - DNA, 625 bp, Homo sapiens
  misc_feature: GZ8MTXP02J2MZM.9.27.C05.1.454.CMB.2.raw
  modified_base (204)..(204): a, c, t, g, unknown or other
  modified_base (426)..(426): a, c, t, g, unknown or other
  modified_base (434)..(434): a, c, t, g, unknown or other
  modified_base (592)..(592): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtcgtctcggaagggaaancgcccacctctcgtggtccggcctagtcaggtagttagtaagaacgacctaagttacgccgttacggtaaccaaacgaggacgtaccgtcggaccacgcccctacccgaggtccctcctatacttcgtttagatcgactactcccaagtacggccaggtacgaactccgagacgtagtacaggtcgccgtagggtcgtcgagggacaggttactccacttcncgagctanacgacagtcgtggcggtataaggtaagttttgttttttagtttttaattactttggtacagtcgttaagttagtaggtaacttacgtcggttacctgtgggtacggtacggttccggaacgaagggacgtaagggtgatcgaacgaaactggtgcggntcggaacctaacgtctcgttctctactctcccg

SEQ ID NO: 423031 - DNA, 532 bp, Homo sapiens
  misc_feature: GZ8MTXP02HL221.9.27.C05.1.454.CMB.2.raw
  modified_base (203)..(203): a, c, t, g, unknown or other
  modified_base (365)..(365): a, c, t, g, unknown or other
  modified_base (378)..(378): a, c, t, g, unknown or other
  modified_base (397)..(397): a, c, t, g, unknown or other
  modified_base (424)..(424): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgtagaagcaacttagccttggtaccaacagacgacctggccagccctcccgaggcctcctcatctttgatgcatccataggccagtgaatcccagacaggttcagtgccagtggtctgggacagagttcactntcagcatcaaacngcgtgcgggctagaagttntttttgttttatattgtcagtcagttntgtatactggcctgtgtggacgttcggacgaagggtacaaggttggatggtacaaaaggtctggtcgactgaacctaccgattccgtgttccttacgtactttccccg

SEQ ID NO: 423032 - DNA, 524 bp, Homo sapiens
  misc_feature: GZ8MTXP02HM00W.9.27.C05.1.454.CMB.2.raw
  modified_base (362)..(362): a, c, t, g, unknown or other
  modified_base (375)..(375): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccatagggccagtggaatcccagacaggttcagtgccagtggtctgggacagattcactntcagcatcaaacngcgtgcggctagtaagtttatttttagtttttaattagttgtactagtactagttatgtaatacgtggtcctgtgtcggtacgttcggaccgtaagggacaaggtgatgtaacaaacgtactgcgctgaacacatctgtcttacattcc

SEQ ID NO: 423033 - DNA, 535 bp, Homo sapiens
  misc_feature: GZ8MTXP02JQSN6.9.27.C05.1.454.CMB.2.raw
  modified_base (201)..(201): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaacagagacctggccagcctccaggctcctcatctttgatgcatccataggccagtggaatcccagacaggttcagtgcagtggtctgggacagagttcactctcagcatcaacagcgtgcgggctgaagtatttttgttttattattgtcagtctagttatgtataacgtggccttgtggtggtacgttcgggaccgaaaggggtaccaagggttcggatggtacaaaacggtactgtaggcctggaacctacctatcctgtcctttacactttcccg

SEQ ID NO: 423034 - DNA, 535 bp, Homo sapiens
  misc_feature: GZ8MTXP02ILD78.9.27.C05.1.454.CMB.2.raw
  modified_base (202)..(202): a, c, t, g, unknown or other
  modified_base (259)..(259): a, c, t, g, unknown or other
  modified_base (286)..(286): a, c, t, g, unknown or other
  modified_base (353)..(353): a, c, t, g, unknown or other
  modified_base (365)..(365): a, c, t, g, unknown or other
  modified_base (374)..(374): a, c, t, g, unknown or other
  modified_base (383)..(383): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcgggccagtcagagtgttagaagcaacttagcctggtaccaanagagacctggccagcctccagctcctnatcttgatgcatccataggccagtgaatccagacagtcagtgcagtggctgggacagagttcactcncagcatcaaacngcgtgcggntagaagttntttttgttttatattgtcagctagtatgtataacgtggccttgtggtcggacgttcggaccgaaaggggtaccaaagggttcggattgaacaaaacggtacgttgtcggacctggaacctaacctattccgttcgttctttactacttcccg

SEQ ID NO: 423035 - DNA, 805 bp, Homo sapiens
  misc_feature: GZ8MTXP02IH3OB.9.27.C05.1.454.CMB.2.raw
  modified_base (204)..(204): a, c, t, g, unknown or other
  modified_base (293)..(293): a, c, t, g, unknown or other
  modified_base (318)..(318): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgggaaggagcncctacctctcgtcggtccgactacgcgagtagttagtaagacgacttaacgtacgtcgtacgaaccagagacgtcgcgacaccgtcccnccgacgtcctccactactttcgtangtcactacctaccgtaacggtacggacgtaggacgtaccctacgaacgacggttacgtacgtaggtcgacgtaggggtcggttcggaggacgtaggttactaccgtctctacgacctactacgaacaaacggtcggtcggcggggtaccgtagttaaaggtttaaaagtttttttgtttttttttaacggttttaattcggttacggtactacgtaagggtttaaatttaggtaacgtttaaaaccgttacgggttccggttacccttgggggttacggggttaaaccggtttcccgggggttaaccccgggaaacggggtaaaacccggggtaaaacggggttacgggggtaacgttacgggttaacccggaaaaaccgtaaaaacccgggttgggttcggggtaaccggtccgtaaccgaacccgttaaaccgtttcgtttaccggtttaccttttcccgttaacctttcccccgtttcccccgg

SEQ ID NO: 423036 - DNA, 555 bp, Homo sapiens
  misc_feature: GZ8MTXP02HBCWM.9.27.C05.1.454.CMB.2.raw
  modified_base (201)..(201): a, c, t, g, unknown or other
  modified_base (209)..(209): a, c, t, g, unknown or other
  modified_base (377)..(377): a, c, t, g, unknown or other
  modified_base (387)..(387): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaangccacctntcctgtcgggccagtcagagtgttagaagcaacttagcctggtaccaacagagacctggccagcctccaggctcctcatctttgatgcatccactagggccagtggaactcccagacagttcagtgccagtgggtctggggacagacgttcactctcagcatcaaacngcgtgcgggntagaagttatttttgttttattattgtcagtctagttatggtataactggtaccctgtggtcggtacgttcggaccgtaaaggggacctaaaggggttggacttggtactaaaacggtacgttggtacggcttaggcctaccagttctaggttccttcactttccccg

SEQ ID NO: 423037 - DNA, 628 bp, Homo sapiens
  misc_feature: GZ8MTXP02GLJYP.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcggccagtcagagtgttagaagcaattagcctggtaccaacagagacctggccagcctcccaggctcctcatctttgatgcatccatagggccaggtggaactcccagacaggttcagtggccaggtgggtctaggggacaggtacgttcacgtctccgagccaagtccaaacgagccggttggcccgggggtacttaggtaaagtttagtttttttgtttttttaattagttttcggtactaagtcgtaaggttaattggtaaacttaacgttcgggtacctcgtaggttacgggtaccgtttcggggaccgtaaaggggaccgtaaaggggttcggaattacggtaaccaaaacggtacttggtacggactacggaaccgacctagttcctgttccttactactttcccg

SEQ ID NO: 423038 - DNA, 588 bp, Homo sapiens
  misc_feature: GZ8MTXP02GDTE1.9.27.C05.1.454.CMB.2.raw
  modified_base (203)..(203): a, c, t, g, unknown or other
  modified_base (385)..(385): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtaccaacagagacctggccagccctcccaggcctcctcatctttgatgcatccataggccagtgaactcccagacaggttcaggtggccaggtgggtctggggacaggagttccactctcagcatcaacngcgtggcgggctaggtaagtttatttttgtttttaatagtttgtactagtctaaggttatggtaattaacgtcggtacctcgtggtacggtacggttcggaccgtaaaggggacctaaggggtggacttgggtaaccaaaacggtacgtggtacgggcttacggaacctaaccgtattccgtgttaccttacgactttccccg

SEQ ID NO: 423039 - DNA, 524 bp, Homo sapiens
  misc_feature: GZ8MTXP02F563C.9.27.C05.1.454.CMB.2.raw
  modified_base (202)..(202): a, c, t, g, unknown or other
  modified_base (258)..(258): a, c, t, g, unknown or other
  modified_base (344)..(344): a, c, t, g, unknown or other
  modified_base (361)..(361): a, c, t, g, unknown or other
  modified_base (372)..(372): a, c, t, g, unknown or other
  modified_base (381)..(381): a, c, t, g, unknown or other
  modified_base (511)..(511): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcgggccagtcagagtgttagaagcaacttgcctggtaccaanagagacctggccagcctcccaggctcctcatcttgatgcatccatagggccagtggaatcccagacaggttcagtggcagtggtcngggacagagttcactcncagcatcaacngcgtgcggntagtaagttattttgtttttatatttgtacagtctagtatgtattaacgtggcctcgtggtcggtacgtttcggaccaagggacctaaaggtggatgacaaaacggtactggtacggctggcacatcgtntaccttctactcc

SEQ ID NO: 423040 - DNA, 533 bp, Homo sapiens
  misc_feature: GZ8MTXP02II4PY.9.27.C05.1.454.CMB.2.raw
  modified_base (389)..(389): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccacctctcctgtcggccagtcagagtgtagaagcaacttagcctggtaaccaacagagacctggccagccctccaggcctcctcattctttgatgcatccacgtaggccaggtggaaactccccgaagacaggttcaggtggccaggtgggtctggggacagagttcactctcagcatcaaacngcgtggcgggctaggtaaagttattttttgtttttattagtttgtacagtctagtatgtaatactggcctgtgtaggacgttcggaccaagggaccaagggtcgatgacaaagactgtcgctgaacacatctgtctcgatcccg

SEQ ID NO: 423041 - DNA, 588 bp, Homo sapiens
  misc_feature: GZ8MTXP02HSLU2.9.27.C05.1.454.CMB.2.raw
  modified_base (360)..(360): a, c, t, g, unknown or other
  modified_base (366)..(366): a, c, t, g, unknown or other
  modified_base (378)..(378): a, c, t, g, unknown or other
  modified_base (397)..(397): a, c, t, g, unknown or other
  modified_base (414)..(414): a, c, t, g, unknown or other
tcagtgatacgtctcacgaccggtgctcgatttagacgcgatcgaagggtttgggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaattagcctggtaccaacagagacctggccagcctcccaggctcctcatctttgatacatccatagggccagtggaatcccagacaggttcagtggcagtgggtctggggacagagttcnctctanagcaatcaaacngcgtgcgggctagaagttnttttttgtttttaattntttcgtcagtacaagttatgtaacttaacgtggtccttgttaggtacggtacggttccgggaccgaaaacggggtaacctaaaggggtgaacgttacggttaaccgaaaaacgtacgttggtacggctacgaccaacctagttcgtcgttacctttccactttccccttacccg

SEQ ID NO: 423042 - DNA, 523 bp, Homo sapiens
  misc_feature: GZ8MTXP02HAK78.9.27.C05.1.454.CMB.2.raw
  modified_base (203)..(203): a, c, t, g, unknown or other
  modified_base (380)..(380): a, c, t, g, unknown or other
  modified_base (398)..(398): a, c, t, g, unknown or other
  modified_base (509)..(509): a, c, t, g, unknown or other
  modified_base (513)..(513): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagaagcaacttagcctggtaccaacagagacctggccagcctcccaggcctcctcatctttgatgcatccactaggccagtggaactcccagacaggttcagtgccagtgggtctggggacagagttcactctcagcatcaacngcgtgcgggctgaagttntttttgtttttatagttgtacagctagttatgtaatacgtggccttcgtgtcggtacgttcggactaaaggggaccaagggtggatgtacaaaggtactgtcgctgcactntctntctcactccg

SEQ ID NO: 423043 - DNA, 534 bp, Homo sapiens
  misc_feature: GZ8MTXP02J4MG5.9.27.C05.1.454.CMB.2.raw
  modified_base (409)..(409): a, c, t, g, unknown or other
  modified_base (521)..(521): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggtaaagagcccaccctctcctgtcgggccagtcagagtgttagaagcaacttagcctggtaccaacagagacctggccagcctcccaggctcctcatctttgatgcatccactaggccagtgaatcccagacaggttcagtggccagtggtctggacagagtcactctcagcatcaacagtcgtggcggtcgtgtaaagttatttttattttnttttaagtttattagttcagactagtattagtataacgttcgccgttcgtcgtcggtacggtcgtaccggacgaacggacgaggtagtagtagactaacgacgtcgtgctcnctctctctctctc

SEQ ID NO: 423044 - DNA, 590 bp, Homo sapiens
  misc_feature: GZ8MTXP02IM27U.9.27.C05.1.454.CMB.2.raw
  modified_base (366)..(366): a, c, t, g, unknown or other
  modified_base (388)..(388): a, c, t, g, unknown or other
  modified_base (392)..(392): a, c, t, g, unknown or other
  modified_base (398)..(398): a, c, t, g, unknown or other
  modified_base (409)..(409): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagagcaacttagcctggtaccaacagagacctggcccagcctcccaggcctcctcatctttgatgcatccacgtagggccaggtggaatcccagacaggttcaggtggccaggtgggtctggggacaggngttcatctcagccatcaaacgngcgnggcggntagtaagtttntttttagtttttatagttgtctagtctaagttatagtaacttacgtcggtaccttgtggtacgggtaccgttacggaccggaaacggggtacgtaaggggttcggaacgttaggtaaaccgaaaacggtacgttacggtcggtctacggaacctacgtattcgtcgttccttctacttccg

SEQ ID NO: 423045 - DNA, 645 bp, Homo sapiens
  misc_feature: GZ8MTXP02HN7CM.9.27.C05.1.454.CMB.2.raw
  modified_base (203)..(203): a, c, t, g, unknown or other
  modified_base (392)..(392): a, c, t, g, unknown or other
  modified_base (405)..(405): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgttagagcaacttagcctggtaccaacagagacctggccagccctcccaggcctcctcatctttgatgcatccacgtagggccaggtggaactcccgagactaggttcaggtggccgaggtgggtctggggacaggtagttcacttctcagcatacaacngtcgtggcgggtntaggtaagttattttttgtttttaatagtttgtactagtctagttatggtaattaacgtcgggtacccttgtgggttacgggtacccggtttcggggaacccgtaaaagggggtacccgtaaaagggggttcgggaaacgtttcgggtaaaccgtaaaaaccgggtacgtttaggggtcggtaccgttcggaaccctaaccgtacttccgttacggttccctttaccgtactttcccccg

SEQ ID NO: 423046 - DNA, 526 bp, Homo sapiens
  misc_feature: GZ8MTXP02FTWIU.9.27.C05.1.454.CMB.2.raw
  modified_base (357)..(357): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggcctcctcatctttgatgcatccactagggccagtggaactcccagacaggtcagtgcagtggtctgggacagngttcactctcagcatcaaacagcgtggcggctgaagttattttgtttttaattatttgtacagtctagttatgattactggtacctcgttgtggtacgttcggccgaaaggggaccaagggtcggatagtacaaaacgactgtcggctgcaccatctgttctcattccc

SEQ ID NO: 423047 - DNA, 605 bp, Homo sapiens
  misc_feature: GZ8MTXP02ITK0S.9.27.C05.1.454.CMB.2.raw
  modified_base (385)..(385): a, c, t, g, unknown or other
  modified_base (406)..(406): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctccaggctcctcatctttgatgcatccatagggccaggtcggaactcccagacaggttcaggtggccaggtgggtctggggacagcgttcacttcacagcatacaacngcgtggcggtctgtaaagttnttttttagtttttatatttgtctagtctagttatagtattaacgtcggtccttcgtgggttacggtaccggtttcgggaacccgtaaagggggtaccctaaagggggttcggaacgttcggtaaaccgaaaaacggtacttgggtacggacttcggaaccgaaccgtatttcgtcgtttacctttacgtactttccccg

SEQ ID NO: 423048 - DNA, 568 bp, Homo sapiens
  misc_feature: GZ8MTXP02I82EJ.9.27.C05.1.454.CMB.2.raw
  modified_base (202)..(202): a, c, t, g, unknown or other
  modified_base (211)..(211): a, c, t, g, unknown or other
  modified_base (383)..(383): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctntcctgtcgggccagtcagagtgttagaagcaacttagcctggtaccaacagagacctggccagcctccaggctcctcatctttgatgcatccacgtaggccagtgaactccagacagttcagtgccagtggctgggacagagttcactctcagcatcaacagcgtgcgggtntagtaagttatttttgtttttaatacttgtacagtctaaggttatgtaattaacgtgggaccccttgtggtcggtaccggtttccgggaccgtaaaacgggggacctaaaagggggtcggaattagggtaccaaaacgtacgtgggtacggctacgaaccacctatccgtgtccttcactttccc

SEQ ID NO: 423049 - DNA, 548 bp, Homo sapiens
  misc_feature: GZ8MTXP02GH60A.9.27.C05.1.454.CMB.2.raw
  modified_base (203)..(203): a, c, t, g, unknown or other
  modified_base (391)..(391): a, c, t, g, unknown or other
  modified_base (532)..(532): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccacctctcctgtcggccagtcagagtgttagaagcaacttagcctggtaaccaacagagacctggccagccctccaggcctcctcatctttgatgcatccacgtaggccaggtggaactcccgagacaggttcaggtggccaggtgggtctggggacaggtagttcactctacgagcatacaaacngcgtggcgggtctaggaaagtttatttttgtttttaattattgtacagtactagttatgtaattaacgtggtcctcgtggtcgggtacgttcggaccgaaggggacaagggtggatggtaacaaagctggtcgctgcactntctgtctcacttcccg

SEQ ID NO: 423050 - DNA, 615 bp, Homo sapiens
  misc_feature: GZ8MTXP02IW0KU.9.27.C05.1.454.CMB.2.raw
  modified_base (202)..(202): a, c, t, g, unknown or other
  modified_base (353)..(353): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaagngccaccctctcctgtcgggccagtcagagtgttagaagcaacttagcctggtaccaacagagacctggccagcctcccaggcctcctcatctttgatgcatccactagggccagtggaactcccagacaggttcaggtgccgagtgggtcnggggacagacgttcacgtctcagtcatacaacagcgtgcgggtctaggtaagttattttttgtttttatttagttgttacagtactaagttagtagtaattaacgtcgggtacccttgttcggtagggtaccggtttcgggaccgtaaagggggaacccgtaaaggggtcggaagttacggtaaccgaaaaacggtacgttagggtacggacgttacggaacctaccgtaatttccgtacgttcctttactaactttccccg

SEQ ID NO: 423051 - DNA, 585 bp, Homo sapiens
  misc_feature: GZ8MTXP02FZNSO.9.27.C05.1.454.CMB.2.raw
  modified_base (203)..(203): a, c, t, g, unknown or other
  modified_base (260)..(260): a, c, t, g, unknown or other
  modified_base (384)..(384): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgttagaagcaacttgcctggtaccaanagagacctggccagcctcccaggctcctcatctttgatgcatccacgtagggccaggtaggaactcccagacaggttcagtggccaggtgggtcgtgggacagagttcactctcagcatcaacngcgtggcggggactaggtaaagtttagtttttagttttttaattagtttggtacagtactagtatgattaacgtggacctcgtggtacggtacggttcggaccgtaagggacgaagggtggaagttacggtaacgaaaaccggacgttggtacggacttgaacctaaccgtacttcgtcgtttccttacgtactttccccg

SEQ ID NO: 423052 - DNA, 524 bp, Homo sapiens
  misc_feature: GZ8MTXP02GQBQJ.9.27.C05.1.454.CMB.2.raw
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctccaggctcctcatctttgatgcatccataggccagtgaatcccagacagttcagtgcagtgggtctgggacagagttcactctcagcatcaaacagcgtgcgggctgaagttatttttgtttttatattgtcagtctagtatgatactggctcgtgtggtacgttcggaccgaagggaccaaggtcggatgtacgaaaacgtaacgtgtacggctgctaccgtatccgtgtaccttcactttcccg

SEQ ID NO: 423053 - DNA, 521 bp, Homo sapiens
  misc_feature: GZ8MTXP02F5UHL.9.27.C05.1.454.CMB.2.raw
  modified_base (202)..(202): a, c, t, g, unknown or other
  modified_base (375)..(375): a, c, t, g, unknown or other
  modified_base (405)..(405): a, c, t, g, unknown or other
  modified_base (503)..(503): a, c, t, g, unknown or other
  modified_base (518)..(518): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaaccaacagagacctggccagccctccaggctcctcatctttgatgcatccactagggccagtggaactcccagacaggttcaggtggccaggtgggtctggggacaggagttcactctnagcaatcaaacagcgtgcgggctgaagttnttttgtttttatattgtcagtctagttatgtaataactgggccttgtgtggacgttcggaccaaaggggacaagggtggatgtacaaacgactgtcgntgcacatctgtctcntcc

SEQ ID NO: 423054 - DNA, 619 bp, Homo sapiens
  misc_feature: GZ8MTXP02GAWUG.9.27.C05.1.454.CMB.2.raw
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagccaccctctcctgtcgggccagtcagagtgtagaagcaacttagcctggtaccaacagacgacctggccagccctcccgaggcctcctcattcttgatgcatccacgtaggcctaggtcggaactcccaagactaggttcaggtggccgtaggtgggtcgtaggggacaggtagttcacttctacgagacataccaaacgacggcggttcggccgggggtcttaggtaaagttttattttttaggttttttaattagtttgtacagtactaagttatagtaataaccgtggtaccttcgtggtacggtacggttcggaccgtaaacggggacgtaagggtcggtatacggtaacgaaaacggtacgttggtacggtctaggaacctactatcgtcgtaccttctacgtttcccg

SEQ ID NO: 423055 - DNA, 611 bp, Homo sapiens
  misc_feature: GZ8MTXP02GWTFM.9.27.C05.1.454.CMB.2.raw
  modified_base (205)..(205): a, c, t, g, unknown or other
  modified_base (261)..(261): a, c, t, g, unknown or other
  modified_base (289)..(289): a, c, t, g, unknown or other
  modified_base (352)..(352): a, c, t, g, unknown or other
  modified_base (382)..(382): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaaatagtaatgacgcagtctccagccgtcctgtctgtgtctccgaaggggaaanagccaccctctcctgtcggccagtcagagtgtagaagcaacttagcctggaccaanagagacctggccagcctccaggcctccnatcttgatgcatccacgtagggccagtggaaactcccaagacaggttcaggtgccaggtggtntggggacagagttcactctcagcatcaaanagcgtggcgggctagtaagtttatttttgtttttaatagtttgtactaggtataagtaattacgtaattaaacgttcggtacttcgtaggtacggtacggtttccggaccgaaaggggtaccgaaaaggggtcggtaaagttacggtaaacgaaaaaccggtaacgttggggtacgccgttaggaacctaaccgattaccgttcgtttacttaccgtaactttcccccg

SEQ ID NO: 423056 - DNA, 581 bp, Homo sapiens
  misc_feature: GZ8MTXP02JKJKL.9.27.C05.1.454.CMB.2.raw
  modified_base (262)..(262): a, c, t, g, unknown or other
  modified_base (362)..(362): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaggggaaagagccaccctctcctgtcgggccagtcagagtgtagaagcaacttagcctggtaccaanagagacctggccagcctccaggctcctcatctttgatgcactccacgtaggccaggtcggaactcccgaagacgaggttcaggtggcctaggtggggtcnggggacaggtacgttcacgttctcagtcatacaacagtcgtaggcggggtctaggtaaagtttagttttttagtttttatttagtttgtactagtctaagttatgtaatacgtgccttgtgtggtacgttcggaccgtaagggaccgaagggtcggtatcgtaacgaaacgtacgtggtacggcctagaacactactcgtacttcttacactttccccg

SEQ ID NO: 423057 - DNA, 583 bp, Homo sapiens
  misc_feature: GZ8MTXP02HPLLN.9.27.C05.1.454.CMB.2.raw
  modified_base (202)..(202): a, c, t, g, unknown or other
  modified_base (259)..(259): a, c, t, g, unknown or other
  modified_base (374)..(374): a, c, t, g, unknown or other
  modified_base (446)..(446): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagagcaacttagcctggtaccaanagagacctggccagcctcccaggcctcctcattctttgatgcatccacgtagggccagtggaactcccagacaggttcagtgccaggtggtctgggacaggtagttccacttctnagcaatcaacgagcgtaggccgggtataggtaagtttattttttgtttttaatagtttgctagctaagttangtaatacgtggccttcgagttcgggacgttcggaccgtaaaggggacctaaggggtcgagttacggtaaaccgaaaaacggtcgttggtacggtctacggaacctacagtttccgagtttccttactactttccccg

SEQ ID NO: 423058 - DNA, 643 bp, Homo sapiens
  misc_feature: GZ8MTXP02H664E.9.27.C05.1.454.CMB.2.raw
  modified_base (388)..(388): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggaagaaatagtaatgacgcagtctccagccgtcctgtctgtgtctccaggggaaagacgccaccctctcctgtcgggccagtcagagtgttagaagcaacttagcctggtaaccaacagagacctggccacgccctcccgaggcctcctcatctttgatgcatccacgtagggccaaggtcggaatccccgaagactaggttcaggtggccgagtggggtctggggactaggattcacttcncagcatacaaacaggcgtggccggggtacttaggaaagttttagttttttagtttttaattagtttgtcaagtctagttaattagtaattaacgtggtcccttgtaggtcgggtaaccgttcgggaaccgaaaggggtaaccgaaagggttcgggaaattcgggtaaaaccgtaaaacggtaccgttagggtacgccgttacgaacccgtaaccgtaattccgttacgtttcccttaaccgtaccgtttaccccg

SEQ ID NO: 423059 - DNA, 713 bp, Homo sapiens
  misc_feature: GZ8MTXP02FWSIG.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccacctctcctgtcgggccagtcagagtgttagaagcaacttagcctggtaccaacagacgacctggccagccctccaggcctcctcatctttgatgcatccacgtggccagtggaactcccgagacaggttcaggtggctagggtgggtctaggggactaggtagtttccacgttcctacgaaggtcctaaagttaccgaaaacgtacggtccggggttacggccgggggtacctttagggttaaaaggtttttagtttttttaggttttttttaatttaacgttttggtaccgtaggttacgtaaaggttagttagggtaaactttaaaccgttcgggtaccctttcggttagggttacggggtaccgggtttaccgggaacccggtaaaacgggggacccgtaaaggggtacgggtaagttacggtaaccgaaaaacggtacgttacgggtacggtcgttacggaacccgtaaccgtattccgttcgttcttacctatttcccccg

SEQ ID NO: 423060 - DNA, 704 bp, Homo sapiens
  misc_feature: GZ8MTXP02IXRRO.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangcccacctctcctggtcgggccagtcagagtgttagaagcaacttagcctaggtaacccaacagacgaccctggcccagcccctcccaggcctcctcattctttgatgcactccgacgtagggccaggtacggaactcccgaagacgtaggttcaggtggccgagggtggggtcgtaggggacaggtacgtttcactctacagcaatacgaaactggccgtggaccggggtctagggttaaagtttagttttttttagtttttaattagtttcgtacgtaagtcgtaaaggtttagtaggttaaacttaaaccggttcgggtaccctttagttcggggttacgggttaaccgggtttcccggggaaacccgtaaaagggggtacccgtaaaagggggttcggaaacgtttacggtaaaccgaaaaacggttcgttaggggtacggtactacggtaaccaacccgttagttccgttgtttacccttacgtacctttcccccg

SEQ ID NO: 423061 - DNA, 626 bp, Homo sapiens
  misc_feature: GZ8MTXP02JC5KY.9.27.C05.1.454.CMB.2.raw
  modified_base (203)..(203): a, c, t, g, unknown or other
  modified_base (295)..(295): a, c, t, g, unknown or other
  modified_base (420)..(420): a, c, t, g, unknown or other
  modified_base (608)..(608): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctccgaggggaaangccaccctctcctgtcgggccagtcagagtgtagaagcaacttagcctggtaaccaacaggacgacctggaccagccctcccaggcctcctnattctttgatgcatcccagtacgggcctaggtcggaaactcccgagacgaggttcaggtggacctagggtcggggtactgggggacaggtactttccgacttctacgaagtccaatccaaaacgnggcggttaggccggggtacttaaggtaaagttttattttttttaggtttttaatagtttgactagtacttagttatagtaactacgtggtacccttgtggtacgggtacgtcgggacccgtaaaggggtaccaaggggtcgtattacgaaacgaaacgtagtggacgtctagaacctactgttacgtnttaccttcacgtttcccc

SEQ ID NO: 423062 - DNA, 619 bp, Homo sapiens
  misc_feature: GZ8MTXP02HDIS2.9.27.C05.1.454.CMB.2.raw
  modified_base (202)..(202): a, c, t, g, unknown or other
  modified_base (421)..(421): a, c, t, g, unknown or other
  modified_base (435)..(435): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaangccaccctctcctgtcggccagtcagagtgtagagcaacttgcctggacacagagactggccagccctcccgaggcctcctcattctttgatcgctactcccaacgtacggggcctaggtacggaaactccccgaagaccgtagggtttcaaggtggaccctagggttcggggtactaggggactaggtacgttcaacttcgtacgagcatacgaaacngtcgtggccgggtntaggtaaagttttagtttttttggtttttaattagttgtacgagtctaagttatagtaatacgtgtaccttgtggtacggtacgttcggaccgaaagggaccgtaagggtgattaggtaacaaaacggacgttgacgtctacgaaccgtaaccgtacgttcgttcgttccttacacgtttcccg

SEQ ID NO: 423063 - DNA, 610 bp, Homo sapiens
  misc_feature: GZ8MTXP02I2T53.9.27.C05.1.454.CMB.2.raw
  modified_base (201)..(201): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaangccaccctctcctgtcgggccagtcagagtgttagaagcaacttagcctggtaccaacagagacctggccagccctccaggctcctcatcttgatgcatccacgtagggccaggtggaaactccccagacgaggttcaggtggccaggtgggtctggggacagacgttcactctacagcatcaacagcgtaggcgggctaggtaaagtttatttttgtttttattagtttgtacgagtctagttatggtaattaacgtgggtaccctcgttaggtcggtaccggtttacgggaccgtaaagggggaccctaagggggtacgagttaggtaaccgaaaacggtacttggggtacggtcttacggaaccaacccgttcttaccgttcgtttacctttactaccgtttcccg

SEQ ID NO: 423064 - DNA, 614 bp, Homo sapiens
  misc_feature: GZ8MTXP02JH3KV.9.27.C05.1.454.CMB.2.raw
  modified_base (203)..(203): a, c, t, g, unknown or other
  modified_base (456)..(456): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgttagaagcaacttgcctggaccaacagagacctggccagccctccaggctcctcatctttgatgcatccacgtagggccaggtcggaactcccgagacgaggttcaggtggcctaggtggggtctaggggacaggacgttccgactctcgagcatacaacgagcgtggcgggactaggaagtttatttttgtttttattagtttgtacgtagtcgtaagttancgtaattaacgtcggtacccttgttcggttaggtaccggtttacgaacccggtaaaggggtaacccgtaagggggttacggaacgttacggtaaccgaaaacggtacgttggacggtctacggaacctaccgtatcgttcgtacctttcactttcccg

SEQ ID NO: 423065 - DNA, 552 bp, Homo sapiens
  misc_feature: GZ8MTXP02GI5SW.9.27.C05.1.454.CMB.2.raw
  modified_base (203)..(203): a, c, t, g, unknown or other
  modified_base (363)..(363): a, c, t, g, unknown or other
  modified_base (386)..(386): a, c, t, g, unknown or other
  modified_base (430)..(430): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanagccaccctctcctgtcgggccagtcagagtgttagaagcaacttagcctggtaaccaacagagacctggcccagccctcccaggcctcctcatctttgatgcatccataggccagtggaactcccagacaggttcagtggccagtgggtctgggacagngttcactctcagccatacaaacngcgtgcgggctagaagttattttgtttttattagttgtacagtnagttatgtaatactggtcctcgttggtggtaccgttcggaccgaaagggaccgtaagggtggagtcggtaacaaaacggtactggtacggctaggctacctattctgtacttcactttcccg

SEQ ID NO: 423066 - DNA, 601 bp, Homo sapiens
  misc_feature: GZ8MTXP02GIHA3.9.27.C05.1.454.CMB.2.raw
  modified_base (203)..(203): a, c, t, g, unknown or other
  modified_base (373)..(373): a, c, t, g, unknown or other
  modified_base (397)..(397): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaagngccaccctctcctggtccgggccagtcagagtgttagaagcaacttagcctggtaaccaacagacgacctggcccagccctcccaggcctcctcatctttgatgcatccacgtagggccaggtcggaactcccagacaggttcaggtggccagtgggtctggggacaggngttcactcgtacagcaatcaaacngtcgtcggcgggtactaggtaagtttatttttgtttttaatatttcggtactagtcctaaggttacttaggtaaattacgtcgggtaccttcgtggttacgggtaccgttcggaccgaacggggtaccgtaagggtgacgttacgtaacgaaaacgtacgtggtacggctagaacctacattccgtgttccttacactttcccg

SEQ ID NO: 423067 - DNA, 711 bp, Homo sapiens
  misc_feature: GZ8MTXP02IEL7W.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccaggggaaancgccacccttctcctggtcgggccagtcagagtgttagaagctaacttagccctaggtaacccaacagagacctggcccagccctccaggcctcctcattctttgatgcatccactagggcctaggtgaactcccgaagacgtaggttcaggtggcctaggtggggtctaggggacaggtagttccacgttcacagcctataccgaaacgcggtcgtggcgggggtacttaggtaaagttttattttttttaggttttttaaattagtttcggtactaggtaccttaaggtttaaatacgggttaatttaacccggtggggtccctttacggttggggtttacggggttaacggtttacccggggaaccgttaaaagggggacccgttaaaaggggttacggaacgttaggtaaacccgaaaaaaggttcgttaggggtaccggtcttaaacggcccgtaaaccgttaatttccgttacgtttacctttaccgtaccgttttcccccg

SEQ ID NO: 423068 - DNA, 606 bp, Homo sapiens
  misc_feature: GZ8MTXP02GSHSO.9.27.C05.1.454.CMB.2.raw
  modified_base (203)..(203): a, c, t, g, unknown or other
  modified_base (591)..(591): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaanacgccaccctctcctggtcggccagtcagagtgttagaagcaacttagcctaggtaccaacgagacgacctggcccagccctcccaggcctcctcatctttagatgctactccacgtagggccaggtggaactcccgagactaggttcaggtggcctaggtgggtcgtggggacaggtagttcactctcagcatcaacagcgtggcgggtataggtaaagtttatttttgtttttatagttgtacagtactaaggttatggtaatacgtcgggtacctgtggtacggtaccggttacgggaccgtaaagggggtaccgtaaaggggtcggaagttacggtaaaccgtaaaacggtacgtggtacggctaggaacctaccgtatccgtntccttcactttcccg

SEQ ID NO: 423069 - DNA, 630 bp, Homo sapiens
  misc_feature: GZ8MTXP02JM0RG.9.27.C05.1.454.CMB.2.raw
  modified_base (203)..(203): a, c, t, g, unknown or other
  modified_base (259)..(259): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcgggccagtcagagtgtagaagcaacttgcctggaaccaanagagacctggccagccctcccaggcctcctcatctttgatgcatccataggcagtgaactcccagactaggttcaggtggccaggtgggtctaggggacaggtacgttcacttcacgagcactacaaactagccggtggccggggataggtaagtttattttttggtttttaattagttgtctaagtactaagttaattggtaaattaaccgtcgggtacccttggttaggtacgggtacggtttccggaaccggtaaaggggaccgaaaaggggtttcggaagtttacggtaaccgaaaacgggtaacgttgggtacggctacggaaccgtaaccgttacgttccgtcgttaccttaccgtaccttcccg

SEQ ID NO: 423070 - DNA, 547 bp, Homo sapiens
  misc_feature: GZ8MTXP02IJO57.9.27.C05.1.454.CMB.2.raw
  modified_base (203)..(203): a, c, t, g, unknown or other
  modified_base (402)..(402): a, c, t, g, unknown or other
  modified_base (407)..(407): a, c, t, g, unknown or other
  modified_base (413)..(413): a, c, t, g, unknown or other
  modified_base (424)..(424): a, c, t, g, unknown or other
  modified_base (527)..(527): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaancgccacctctcctgtcgggccagtcagagtgttagaagcaacttagcctggtaaccaacagagacctggccagccctccaggcctcctcattcttgatgctatccacgtacgggcctaaggtcggaactcccgaagacgtagggttcaggtggcctagggtcggtctgggacagtagttcactctcagcagtcaaacgngtcgnggcggntaggaagtttnttttttgtttttaatgttgacagtactagttatgtatacgtgctgtgtcggtcgtcggcgtaagggacaggtcgatgacgaaaagtcgtgacgctagcctacncgttctgttctcgactcccg

SEQ ID NO: 423071 - DNA, 737 bp, Homo sapiens
  misc_feature: GZ8MTXP02INJ7O.9.27.C05.1.454.CMB.2.raw
  modified_base (202)..(202): a, c, t, g, unknown or other
  modified_base (210)..(210): a, c, t, g, unknown or other
  modified_base (427)..(427): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtctgtctgtgtctccgaggggaaangccacctntcctgtcggccagtcagagtgttaagaagctaacttgcctggtaaccaagagagacctggccagccctcccgaggcctcctcattctttgatgctatccacgtagggcctaggtcggaactcccgaagacgtaggttcaaggttcggacctaggggtcggggtactagggggaacaggtacgtttccaacttcgacgaacgcctaactacgaaacgnggtcggtacggtcgggtacgttaggttaaagtttttagttttttttagttttttaaattacgtttacggtacgtagttaacgttaaaggtttaagttaagttaacgtttaacgtccgggtacccgtttacggttaggggttaccgggttaaccgggtttaccggggaaaccggtaaaagggggtaccgtaagggggttacggtaacgttaacgggtaaaccgtaaaacggtacggttcgggtacggtacctacggtaaccctaaccgttacgtttcccgttacgtttaccctttacgtacctttcccccg

SEQ ID NO: 423072 - DNA, 608 bp, Homo sapiens
  misc_feature: GZ8MTXP02JZZMZ.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaacagagacctggccagccctcccaggcctcctcatctttgatgcatccactagggccaggtggaatcccagacaggttcaggtggcaggtggggtctaggggacaggtagttccacttctacagccaatcaaacagccgtggccgggtctaggaaagttatttttgtttttaattagtttgtactagtctaaggttatggaattaacgtgggtcccttgtgggttagggaacccgtttcgggacccgtaaaagggggtccaaaaggggttcggaattcgggtaaccgaaaacggtacgtgtacggaccttggaaccctacctagtcttacgtcctttacaatttcccccg

SEQ ID NO: 423073 - DNA, 593 bp, Homo sapiens
  misc_feature: GZ8MTXP02HDCSM.9.27.C05.1.454.CMB.2.raw
  modified_base (293)..(293): a, c, t, g, unknown or other
  modified_base (367)..(367): a, c, t, g, unknown or other
  modified_base (394)..(394): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcatgtctgtgtctccgaggggaaagagccaccctctcctggtcgggccagtcagagtgtagagcaacttagcctggtaccaacagacgacctggccagccctcccgaggcctccncatctttgatgacatccactagggccaggtgaactcccgagtactaggtcagtcggcaggtgggctggggaacngtgttccacttcgcagtcatccaaagngcgtggcggtattagtaagttttgtttttagttttaatcgttgatagtataagtagtacgtaattacgtcgtaccttgtggtacggtacgtacgggaacgtaaacggggacgtaagggtgtaacgtacgtaaacgaaaacggtacgtggtacggactaacgaccttaactacgttccgttacgttacccttacgtaccg

SEQ ID NO: 423074 - DNA, 642 bp, Homo sapiens
  misc_feature: GZ8MTXP02HAZXK.9.27.C05.1.454.CMB.2.raw
  modified_base (204)..(204): a, c, t, g, unknown or other
  modified_base (261)..(261): a, c, t, g, unknown or other
  modified_base (374)..(374): a, c, t, g, unknown or other
  modified_base (400)..(400): a, c, t, g, unknown or other
  modified_base (413)..(413): a, c, t, g, unknown or other
  modified_base (428)..(428): a, c, t, g, unknown or other
  modified_base (447)..(447): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagngccaccctctcctgtcgggccagtcagagtgttagaagcaacttgcctggtaccaanagagacctggccagcctccaggctcctcatctttgatcgcactccacgtagggccaaggtcggaatccccgaagaccagggtttcaggtggcccagggttgggtctggggacnggtagttcacttcacagcatcaaagngccgtgccgggtntaggtaaagtttttntttttgtttatgttcgtanagtactagttataggtaacttacggtggttcccttggttacgggtacgggttaccggttacggaaccggtaaaggggaccgtaaggggtacggacgtttaaacggtaaacgtaaaacgggtcgttcgggtacggtactacggtaacctaacggttacgtttccgttacgtttacccgtttactacccgtttcccg

SEQ ID NO: 423075 - DNA, 572 bp, Homo sapiens
  misc_feature: GZ8MTXP02IGDSW.9.27.C05.1.454.CMB.2.raw
  modified_base (374)..(374): a, c, t, g, unknown or other
  modified_base (395)..(395): a, c, t, g, unknown or other
  modified_base (405)..(405): a, c, t, g, unknown or other
  modified_base (416)..(416): a, c, t, g, unknown or other
  modified_base (547)..(547): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagagcccaccctctcctgtccgggccagtcagagtgttagaagcaacttagcctggtaccaacagagacctggccagccctccgaggcctcctcatcttgatgcatccacgtagggccaggtggaactccccgagacaggttcaggtggcctaggtggggtctggggacaggngttcactctcagcatcaacgngcgtggcggntaggtaatttntttttagttttatagttgactagtactagtatagtacttacgtggtccttgtggtcggtacgttcggaccgtaagggacgtaagggtcgaatcgaacgtaaaagtcgttggtacgctacgaacctaacgtnttcgtcgttaccttacgtcttcccg

SEQ ID NO: 423076 - DNA, 661 bp, Homo sapiens
  misc_feature: GZ8MTXP02I1HLQ.9.27.C05.1.454.CMB.2.raw
  modified_base (201)..(201): a, c, t, g, unknown or other
  modified_base (397)..(397): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaangccacctctcctgtcggccagtcagagtgttagaagcaacttagcctggtaaccaacagacgacctggccagccctccaggctcctcattcttgatgcatccgatacggcctaggtcggaactcccgagacgtaggttcaggtcggccgtaggtgggtctaggggacaggtattcacgtctacgagcatacaaacngtcgtggacggtctaggtaagtttacttttttgtttttattatttcgtatagtatagttagtagtattaaccgtgggtaccttcgtgggttacgggtacccggtttacgggacccgtaaacgggggaaccgtaaaaggggttggaaacgtttacggtaaaccggaaaaaaccggttacggtttcggggaacgggttccttaacggaaccccgtaaacttacggttccctttaaggtttccctttacgttaacgttttccccccg

SEQ ID NO: 423077 - DNA, 618 bp, Homo sapiens
  misc_feature: GZ8MTXP02F31EP.9.27.C05.1.454.CMB.2.raw
  modified_base (203)..(203): a, c, t, g, unknown or other
  modified_base (212)..(212): a, c, t, g, unknown or other
  modified_base (260)..(260): a, c, t, g, unknown or other
  modified_base (362)..(362): a, c, t, g, unknown or other
  modified_base (396)..(396): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctntcctgtcgggccagtcagagtgtagaagcaacttagcctggtaccaanagagacctggccagcctccaggcctcctcatctttgatgcatccactagggccaggtcgaatcccgagactaggttcaggtggccaggtgggtctggggacngagttcactctacagcatcaaacagcgtgcgggntaggtaagttattttgtttttattagtttgtactagtctaagttataggtaactaacgttcgggtccttcgtaggttcgggtaccggtttaccgggaccggtaaacggggaccgtaaggggtaggtaacgttacggtaaacgaaaaacggtaacgttggtacgggccttacggaaccgtacccgtaagtttccgtacggtttccttaccgtaactttccccg

SEQ ID NO: 423078 - DNA, 751 bp, Homo sapiens
  misc_feature: GZ8MTXP02IN2R5.9.27.C05.1.454.CMB.2.raw
  modified_base (204)..(204): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaagngccaccctctcctgtcggccagtcagagtgttagaagcaacttagcctggtaccaacagagacctggccagccctcccaggcctcctcattctttgatgctactccacgtacgggcctaggtcggaaactcccgagacctaggttcaggtcggacgtaggttcgggtcgtggggactaaggtacgttcctaactcctacgaacgtccaagttaccaaaacgcgtccggtaggtccggggacttaagggttaaaacgtttttattttttttttagggttttttttaaatttagttttacgttaccgtaaggttaccgttaaggtttaaataggttaaacttaaccggttcggggttaccccctttggttacggggtttacgggttaacccggggtttacccgggacccgtaaaacgggggacccgttaaaagggggtttacggaacgtttccgtaaaacggtaaaaccggtacgtttcggggtacgtcgttaaccggaactaacccggtatttccgttagtttacccctttacgaacgttttcccccg

SEQ ID NO: 423079 - DNA, 598 bp, Homo sapiens
  misc_feature: GZ8MTXP02GDE1H.9.27.C05.1.454.CMB.2.raw
  modified_base (202)..(202): a, c, t, g, unknown or other
  modified_base (262)..(262): a, c, t, g, unknown or other
  modified_base (375)..(375): a, c, t, g, unknown or other
  modified_base (400)..(400): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctcgaggggaaangccacctctcctgtcgggccagtcagagtgttagaagctaacttagcctaggtaaccaanagagacctggccagccctccaggctcctcatcttgatgcatccagtacggccaggtgaactcccagactaggttcaggtggcctaggtgggtctgggacagtattcactctanacgcaatcaaacagtcgtggccggntagtaaagtttatttttgtttttattagtttgtacagtactaagttataggtaacttaacgtcggtccttacgtggtacgggtaccggttccggaccgaaaggggaccgtaaaggggtggacttacggtaacaaaacggtaacgttggtaacgcttacggaacctaccgagttctacgtttactacctactttccccg

SEQ ID NO: 423080 - DNA, 635 bp, Homo sapiens
  misc_feature: GZ8MTXP02F92L4.9.27.C05.1.454.CMB.2.raw
  modified_base (205)..(205): a, c, t, g, unknown or other
  modified_base (265)..(265): a, c, t, g, unknown or other
  modified_base (595)..(595): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggcctcccagatatcaatggaagaaatagtaatgacgcagtctccagccgtcctgtctgtgtctccgaggggaaanagcccaccctctcctgtcgggccagtcagagtgttagaagcaacttgcctaggtaccaanagacgacctggccacgcctcccgaggcctcctcattctttgatgcactccgacgtacgggccaggtcggaactccccagtacgtaggtcaggtcggccgaggttggggtcgtaggggacagtacgttcacttctacacgcataccaaacgaggcgtgggcgggtacgttaggttaaagtttagtttttagtttttttaattagtttagtactagtactaagttatacggtaattaacgtggtaccttacgtggtacgggtacggtttacggaccggaaagggtaccgaaagggtgtacgtaggtaacgaaaacgtaacgtggtacggtcncgaacctaccgtactccttgttccttactacctttccccg

SEQ ID NO: 423081 - DNA, 673 bp, Homo sapiens
  misc_feature: GZ8MTXP02H8OVY.9.27.C05.1.454.CMB.2.raw
  modified_base (201)..(201): a, c, t, g, unknown or other
tcagtgatacgtctcacgaccggtgctcgatttagacgcgatcgaagggtttggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaanagccaccctctcctgtcgggccagtcagagtgttagaagcaacttagcctggtaaccaacagagacctggccacgcctcccaggctcctcattcttgatcgcatccacgtagggccaggtcggaactcccgagacgaggttcaggtcggccgaggtggggtcaggggacaggtacgttcaacttctccgagtcaacgtacaaactggcgtcggccggggtacttaggaaagttttagttttttttaggttttttaattaacgttggttactagtagttaggtttaatgttaaacgttacgtcgggtcccttcgtagggtcggtaaccgggtttcggaacccggtaaaggggtacccgaaagggttacggaaacgtttggaaaacccgtaaaaccgggtaaacgttcgggtacgggtccttaacgaaccgtaaccctagtctttacggtttccctttaactcctttacccccg

SEQ ID NO: 423082 - DNA, 511 bp, Homo sapiens
  misc_feature: GZ8MTXP02IGM9T.9.27.C05.1.454.CMB.2.raw
  modified_base (203)..(203): a, c, t, g, unknown or other
  modified_base (326)..(326): a, c, t, g, unknown or other
  modified_base (374)..(374): a, c, t, g, unknown or other
  modified_base (384)..(384): a, c, t, g, unknown or other
  modified_base (409)..(410): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagngccaccctctcctgtcgggccagtcagagtgttagaagcaacttagcctggtaaccaacagagacctggccagccctccaggcctcctcatcttgatgcatccataggcagtgaatccagacnggtcagtgcagtgggtctgggacagacgttcactctcagcaatcaacngcgtgcgggntgaagttatttttgttttatagttnnagctagtatcgataacgtggaccttgtggtggcgttcggcctaaagggaccagggtgatgtacaaaagactgtggctggcacatctgtctttcacgtttcc

SEQ ID NO: 423083 - DNA, 721 bp, Homo sapiens
  misc_feature: GZ8MTXP02GERL5.9.27.C05.1.454.CMB.2.raw
  modified_base (269)..(269): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaaggggaaagcgcccaccctctcctggtccgggccagtcagagttgttagaagctaacttagcctaggtaaccaanagacgacctggccagccctccgaggtcctcctcattctttagatcgcctactcccgaacgtacgggccaaggtcggaaactccccgaaggtaccgtaaggttcgaaggttcggaccgtagggttcggggtacgtaggggaactaagggtacgttccaaccttcgtaccgaacgtaccaataccgaaaacgacggtcggttacggccgggggtacttaagggttaaagtttttagttttttaggttttttaatttagtttcggtactaggttacgtaagttaagttagtaacgttaacgtcggtccttcgtaggtacggtacgttaccggacggaaacgggtacgtaaggggtacggtaacgtacggtaaacgtaaaacggtaacgtcgggtacgtcgttacgaaccgtaaccgtatttcccgttacgttacctttcgtaaccgttttccccg

SEQ ID NO: 423084 - DNA, 701 bp, Homo sapiens
  misc_feature: GZ8MTXP02HVFFY.9.27.C05.1.454.CMB.2.raw
  modified_base (201)..(201): a, c, t, g, unknown or other
  modified_base (336)..(336): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccaggggaaangccacctctcctgtcggcagtcagagtgttagaagctaacgttagcctaggtaacccaacagacgacctggacccagccctcccgaggcctcctcattctttgatgcatccacgtaggcaggtgactcccagacnggttcaggtgcctaggtcgggtctaggggactaggtacgtttccacgttctacacgctaagtaccaaaacgcgtacgttacggcggggtacttaggtaaacgtttttagtttttttaggtttttttaaattagtttaggttacgtaagttaccgttaaggtttaacttaggtaaatttaaaccgttcgggtaccctttacgttcggggttacggggtaaccggtttccgggaaccgtaaacgggggtaaccgtaaaggggtgggtaaactttacggtaaaccgtaaaaacggtacgtgggtacggtacttacggaaccgtaacctaagtttccgttaacgtttccttaccgttaactttcccccg

SEQ ID NO: 423085 - DNA, 646 bp, Homo sapiens
  misc_feature: GZ8MTXP02FTCC9.9.27.C05.1.454.CMB.2.raw
  modified_base (203)..(203): a, c, t, g, unknown or other
  modified_base (212)..(212): a, c, t, g, unknown or other
  modified_base (262)..(262): a, c, t, g, unknown or other
  modified_base (336)..(336): a, c, t, g, unknown or other
  modified_base (377)..(377): a, c, t, g, unknown or other
  modified_base (389)..(389): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctntcctgtcgggccagtcagagtgttagaagcaacttagcctggtacccaanagagaccctggcccagccctcccgaggcctcctcatctttgatgcatccagtaggccagtggaactcccagacnggttcagtggccaggtggtctggggacagtagttcactctnagcataccaaanagtcggtggcgggctaggtaagtttagttttgttttttaattagtttgtacgtagtacgtaagttagtagtattaaccgtgggtaccttcggttggttcgggtaaccggtttcgggaaccgtaaacggggtaacccggtaaaggggtagggtacgttaggttaaaccgaaaaccggtaaacgttcgggtacggtccgtacggaaccctaaacccggttacgttaccgttacgtttaccttaccgttacctttacccg

SEQ ID NO: 423086 - DNA, 678 bp, Homo sapiens
  misc_feature: GZ8MTXP02JSZVS.9.27.C05.1.454.CMB.2.raw
  modified_base (202)..(202): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaangccacctctcctggtcgggccagtcagagtgttagaagcaacttagcctggtaccaacagagacctggccagccctccgaggcctcctcatctttgatcgctactccacgtacgggcctaggtacggaaactccccgaagtacgtagggttcaggtggacccgtagggtggggttcgaggggacaggtacgttcacgtctcagcatacaaacgacgcgtaggccgggtcttaggtaaacgtttagtttttttggtttttaattacgtttgtaccgtaagtcgtaagtttagtaggtaacttaaacgtcgggtacccttgttaggggtcggttaacccggttcggggaaccgtaaacgggggtaaccctaagggggttcggaacgttaacggtaaacccggtaaaacgttaccggttgggttacggaccttcggaacctaccgtacttccgttgtttacccttcgtaactttccccg

SEQ ID NO: 423087 - DNA, 536 bp, Homo sapiens
  misc_feature: GZ8MTXP02JQMU9.9.27.C05.1.454.CMB.2.raw
  modified_base (202)..(202): a, c, t, g, unknown or other
  modified_base (261)..(261): a, c, t, g, unknown or other
  modified_base (383)..(383): a, c, t, g, unknown or other
  modified_base (395)..(395): a, c, t, g, unknown or other
  modified_base (520)..(520): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccaccctctcctgtcgggccagtcagagtgttagaagcaacttagcctggtaccaacngagacctggcccagccctcccaggcctcctcatctttgatgcatccatagggccagtggaatcccagacaggttcaggtgccaggtgggtctggggacagagttcactctcagcatcaaacngcgtggcgggtntagaagttatttttgttttatattgtcagtctagttatgaatacgtggaccttgtggtggtacgttcggaccaaggggaccaagggtggaattggtacaaacgtacttcgacggctagcaacgtntctgtcctcacttccg

SEQ ID NO: 423088 - DNA, 743 bp, Homo sapiens
  misc_feature: GZ8MTXP02IST6N.9.27.C05.1.454.CMB.2.raw
  modified_base (200)..(200): a, c, t, g, unknown or other
  modified_base (275)..(275): a, c, t, g, unknown or other
  modified_base (426)..(426): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtctgtctgtgtctccaggggaangccacctctcctgtcgggccagtacgagtgttagtagacactacgtcgtcgtacgaacagagacgtacgtcgacnctcccctacgacgtcctccactactttcgtagtatcgactaccgtaccgtaacgggtaccggactaaggggtaacgtacccctaccggaacgtacggttacgtagtagggtcgaccgtaggggttcgtgggtaacggagtagttcgtaccncttccaggacactacaacaaacgcggtacggtcgggaccgtagtaaggtaattttttaggtttttttatttttaaattcgtttacgacgtacggtaatttaaggttagaacgttaaacgttacgggtccggttaacccgttgtcgggggttaccggtttaccgggtaccggaaaccggggttaaacgggaacggttaaggggtaggttaaacgttccgaaaaaccggtaaaacgttacggttgggcccgttaacggcctaaaaccgtaaacccttgtttccgttccgtttacgttacctaacccgtttttcccccgg

SEQ ID NO: 423089 - DNA, 822 bp, Homo sapiens
  misc_feature: GZ8MTXP02JNNSA.9.27.C05.1.454.CMB.2.raw
  modified_base (202)..(202): a, c, t, g, unknown or other
  modified_base (291)..(291): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctcgaggggaaancgccaccctctcctggtcgggccagtcagagtgtagagcaacttagcctggtaccaacagagacctggccacgcctccgaggcctcctnatctttgatcgcactccacgtaggggcctaaggtacggtaacctccccgaagtaaccgtagggtttaccaagggttcggacccgtaggggttcggggtacgttacgggggaactaacggttacggttttaccaaccgtttccgttacgaaacggacctaaacgttaccgaaaaaccggtcggggtccggggttaacggggccggggggttaaccttaaggggtttaaaacggtttttagtttttttttttaacggggttttttttaaatttaacggtttcggtttagaaaccgggttacgttaaaggtttagttaacggttaaaccgtttaaacggttccggggttaccccgtttggtttacgggggttaacgggggttaaccccgggtttcgggaaacccgggtaaaacgggggtacccgtaaaagggggttcggtaaacgttacggtaaaccgtaaaaacggttccgttggacggtcctacgaacccgtaaccttagtccgtacgtttactttaccgtactttcccccg

SEQ ID NO: 423090 - DNA, 615 bp, Homo sapiens
  misc_feature: GZ8MTXP02FVM35.9.27.C05.1.454.CMB.2.raw
  modified_base (204)..(204): a, c, t, g, unknown or other
  modified_base (294)..(294): a, c, t, g, unknown or other
  modified_base (395)..(395): a, c, t, g, unknown or other
  modified_base (420)..(420): a, c, t, g, unknown or other
tcagtgatacgtctcacgaccggtgctcgatttagacgcgatcgaaggggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaangccaccctctcctgtcggccagtcagagtgttagaagcaacttagcctggtaaccaacagacgacctggcccagccctccaggcctcctnatctttgatgcatccagtacggcctaggtgaactcccagacaggttcaggtggcctaggtggtctagggactaggcgttcactctacagtccatacaaacngcgtggcgggtcttaggtaagtttntttttagttttttaatacgttgtacagtacgtagttatcggtaagtaccgtcggtccttggtggtacgggtaccggttcgggaaccggaaacggggtacgtaagggtacgtacgttacggtaaacgtaaaacggttcgtagggtacgtcctacgaacctacgtacttcgttcgtttacctactaccgtttccccg

SEQ ID NO: 423091 - DNA, 702 bp, Homo sapiens
  misc_feature: GZ8MTXP02HC8QM.9.27.C05.1.454.CMB.2.raw
  modified_base (203)..(203): a, c, t, g, unknown or other
  modified_base (449)..(449): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctccgaggggaaangccaccctctcctggtcggccagtcagagtgttaagaagcaacttagccttaggtaccaacagacgacctggcccacgccctacccgaggtccctcctctactctttagactgcctaatcccaacggtagggccctaaggtggaaaccctcccaaaggtacctaaagggttcaggtcggcccgtagggttgggtaccgtggggaactaggtacgtttccacttctacgactacaactacgaaacgnggtcggtcggacggtagttagttaaagtttttgtttttttacgttttaattagttcgtagtaagtagttaaagttgagttaacgtacgtgttcctggttacgggtacggtaccgttacgggaccggtaaaacggggtacgaagggttacggtaacgttacggtaaaacgtaaacggttacgttcggggtaacgtcgttaacggaaccctacgttaacgtttcgttacgttacctttaccggttaccttccccg

SEQ ID NO: 423092 - DNA, 717 bp, Homo sapiens
  misc_feature: GZ8MTXP02IPLXR.9.27.C05.1.454.CMB.2.raw
  modified_base (202)..(202): a, c, t, g, unknown or other
  modified_base (211)..(211): a, c, t, g, unknown or other
  modified_base (253)..(253): a, c, t, g, unknown or other
  modified_base (283)..(283): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggaagaaatagtaatgacgcagtctccagccgtcctgtctgtgtctcgaggggaaangccacctcncctgtcggcagtcagagtgtagagcaacttagctggaccaanagagcctggccacgccctccaggcctcctntatctttgatcgactactccacgtaggggcctaggtacggaaactccccgaaggtacgtacggggttaccaagggttggacccgtagggttcggggtacgtaggggaacaggttacgttccaaccttcgtacgagtacctaactaccgaaactggggtccgttggggacccggggacttaagggtaaaagtttttgttttttttaggtttttaattaagtttcggttacaggttacagtttaacgtagtaacttaacgtcggtcccttgtgggttacgggtaccggttacgggacccgtaaaacgggggtccctaaaagggggtcgtaacgttaaccggtaaaccgtaaaaacgggtaaccggttggtaccgggtacttaccggaaccgtaaaccctagttcccgtttacgtccgttttacaccgtttcccccg

SEQ ID NO: 423093 - DNA, 696 bp, Homo sapiens
  misc_feature: GZ8MTXP02JK8V6.9.27.C05.1.454.CMB.2.raw
  modified_base (203)..(203): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaaancgccaccctctcctggtccgggccagtcagagtgttagaagcaacttgcctaggtaccaacgagacgacctggccagccctcccaggcctccctacacttctttgatcgcactccagtacggccaaggtcggaatccccgagaccgtaggttcaggtcggcgtaggttcggggctggggaacaggtacgtttccacgttctccgagctaatcgaaaactggcgttcggcggggtacttaggtaaaagttttgtttttttagtttttaattagtttagtctaaaggttactaaggtttaaactgaacctttaacgttcgggtaccctttggttaggtaccgggtaccggtttccgggaaccggtaaacgggggtaccgaaaagggggtttctaacgtacgggttaaacccaaaacggggttattcgggggtacgtacctagggaacccaaaccgttacgttaccttcgtttcccctttagacccttttccccgg

SEQ ID NO: 423094 - DNA, 647 bp, Homo sapiens
  misc_feature: GZ8MTXP02FZM6H.9.27.C05.1.454.CMB.2.raw
  modified_base (202)..(202): a, c, t, g, unknown or other
  modified_base (259)..(259): a, c, t, g, unknown or other
  modified_base (290)..(290): a, c, t, g, unknown or other
  modified_base (387)..(387): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaangccacctctcctgtcgggccagtcagagtgttagaagcaacttagcctggtaccaanagagacctggcccagccctcccaggcctccncatctttgatgcatccagtagggccagtggaatcccagactaggttcagtggccaggtgggtctaggggactagagttcactctcagcaatcaaacngcgtagcgggctggtaaagttatttttgtttttaatagttgtacagtacctaagttatacggaattaaccgtgggtccttacgttaggtcgggtaaccggtttcgggacccgtaaagggggtaaccctaaaggggttcgggaaacttagggttaaaccgaaaaaccggttaacgttacggggttacgggacccgttaggaacccgtaacccggtaaatttcccggttagtttaccccgttaccgtaacttttccccccgg

SEQ ID NO: 423095 - DNA, 603 bp, Homo sapiens
  misc_feature: GZ8MTXP02IG0EI.9.27.C05.1.454.CMB.2.raw
  modified_base (199)..(199): a, c, t, g, unknown or other
  modified_base (208)..(208): a, c, t, g, unknown or other
  modified_base (212)..(212): a, c, t, g, unknown or other
  modified_base (254)..(254): a, c, t, g, unknown or other
  modified_base (276)..(276): a, c, t, g, unknown or other
  modified_base (280)..(280): a, c, t, g, unknown or other
  modified_base (324)..(324): a, c, t, g, unknown or other
  modified_base (348)..(348): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtctgtctgtgtctcgagggaaancgccacctntccngtcggcagtcagagtgtagaagcaattgcctggacaacaganacgtgccagcctccagctcctnactntttgattgcatccagtaggccaggtgaactccaagacaggttanacggtgccgagttggacgtggacnggtctcactgactagacataccagacgtcggaggcggtacttaggaagtttttaatttttttggttttttaaactagtttacgtaccgtaagtacgttaaagttagtttaagtaacgtttaaacgtcggggtacctttgggtacgggttacggtcggttaccggaacccggtaaagggtaaccgaaggttacgagttgaacccgaaaagtactggtacgatacgcgtaactattcggtcttactacgtctccccg

SEQ ID NO: 423096 - DNA, 692 bp, Homo sapiens
  misc_feature: GZ8MTXP02GS70I.9.27.C05.1.454.CMB.2.raw
  modified_base (204)..(204): a, c, t, g, unknown or other
  modified_base (651)..(651): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctaccgaaggggaaancgccaccctctcctgtccggccagtcagagtgtagagcaacttgcctaggtaaccaacgagacgacctggcccagccctccgaggcctcctctattcttagatcgacactccaacgtacgggacctaggtacggaactcccgaaggtactaggtcaggtggccgtagggtgggtacgaggggaacaggttacgttccacgttctacgacgtccaattacccaaaagtcgggcggttacggggacggggtactttaaagggttaaagtttttttagtttttttaggttttttaataacggttttgaccgtaaggttactaaagttatacggtaaaacttcggtcggtccttacgtgggttaccggtacccggttacggaacccggaaaggggaccgtaagggttcggaacttaacgggtaaaccaaaaggtacgttggacggttaccnggaacctacctgttacctcgttacctacgtacctttccccg

SEQ ID NO: 423097 - DNA, 760 bp, Homo sapiens
  misc_feature: GZ8MTXP02FHD5U.9.27.C05.1.454.CMB.2.raw
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtctgtctgtgtctccgaaggggaaagcgcccacctctctgtcgggccagtcagtagtagttagaagctaacgttacgcctaggtaacccaagagacgaccgtcggccacgcccctacccgaggtccctcctcactttctttagatcgcactcccgagtacggctaaggtacggaacctcccgaaggtaccgtagggttcgacggtcggggacccgtaggggttcggggtacgtacggggacaacggttacggtttccaccttcctacgaaacgtcctaactaccgaaacgacgggtccggggtacggtacccgggggtatttaagggttaaagttttttagtttttttaggttttttaattaggttttcgacgtaagtacgttaaaggttaagttaacggtaactttaaccgggtcggttccccgttggttaggggtaccggggttaccggttacccggggaacggtaaacggggtaccgtaaaggggttcggtaacgtaacggtaaccaaaaacggttaccgtggtaccggactcggaaccgtactcgtttacccgttctttaccgtaccttacgtccccg

SEQ ID NO: 423098 - DNA, 733 bp, Homo sapiens
  misc_feature: GZ8MTXP02HZKG5.9.27.C05.1.454.CMB.2.raw
  modified_base (203)..(203): a, c, t, g, unknown or other
  modified_base (446)..(446): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctcagccgtcctgtctgtgtctccgaggggaaanagccacctctcctgtcgggccagtcagtagtagttagagactaattagctaggtaacaacagagactcggccacgccctccacggcctcctactacttctttgaatcgactactaccaacggtacggccaaggttacggaaacctacccgaagtaacgtaacggtttcgagggttcggaccggtaggttggggttcgtaggggaacgtaggtacgttcactctcgacgactaactacaaacgnggtacggacggtccgggattagtaaaggttttattttttaggttttttattaagtttgtacgtaagtacgtagttaaacgtagttaacttaaaccggttcgggtcctttacggtacgggttacggggtttaaccggttacgggaaacccgggaaacgggggtaaacccggtaaaagggggtaggttaaaacggttacggtaaaaccgtaaaacggtaacgttacgggtacggtacgttacgaacctaccgtaaaggttccctaagtttcccttacttactttccccg

SEQ ID NO: 423099 - DNA, 602 bp, Homo sapiens
  misc_feature: GZ8MTXP02HQ7DX.9.27.C05.1.454.CMB.2.raw
  modified_base (260)..(260): a, c, t, g, unknown or other
  modified_base (460)..(460): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccaaggggaaagagccaccctctcctggtcggccagtcagagtgttagagcaacttgcctggaccaanagagacctggccacgcctcccaggcctcctcacttctttgattgcactcccaacgtaggccaggtggaaactcccagacgaggttcagtggccaggtggtcgtggggactggaagttcacgtctaccgagacatacaaacgcgcgtggacggtctagggtaagtttagttttttagtttttacttaagttcgtataggtntagttatacgtataaccgtggtcctgtgtacggtacgttcggaccgaagggaccgaagggtacgattcgaaacgtaaaacgtaacgttcggtacggtactacgaaccgtaacgtacgtcgttcttccttactacctttcccg

SEQ ID NO: 423100 - DNA, 712 bp, Homo sapiens
  misc_feature: GZ8MTXP02IOLPL.9.27.C05.1.454.CMB.2.raw
  modified_base (201)..(201): a, c, t, g, unknown or other
  modified_base (629)..(629): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtctgtctgtgtctccgaggggaancgccacctctcctggtcggccagtcagagtgttagaagctaacttgcctaggtaaccaacagacgactcggccacgccctccgaggcctcctcattcttgatgacactccacgtacggccaggtcggaactcccgaagaccgtaggttcgaaggtcggcccgtaggtcgggtacgtaggggactaggttacgttccgactctaccgacgtacctaataccaaacggtcggtccggtacgggaccggggtattaaggggtttaaaagtttttagtttttttttttacgggttttttaaatttacgtttagggttactaggttaacttaaaggtttagttacgtaaactttaccgtcgggttacccttggttagggttaccgggttacggttacccggggacgtaaaacgggggccgttaaagggggttnaaacggttacgtaaaccggaaaacgttacgtggtacggtcttacggaactaaccgtctttacgtctttccttactaccttccg

SEQ ID NO: 423101 - DNA, 644 bp, Homo sapiens
  misc_feature: GZ8MTXP02GIYFA.9.27.C05.1.454.CMB.2.raw
  modified_base (202)..(202): a, c, t, g, unknown or other
  modified_base (314)..(314): a, c, t, g, unknown or other
  modified_base (389)..(389): a, c, t, g, unknown or other
  modified_base (401)..(401): a, c, t, g, unknown or other
  modified_base (423)..(423): a, c, t, g, unknown or other
  modified_base (429)..(429): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctccagatatcaatggagaaatagtaatgacgcagtctccagccgtcctgtctgtgtctccgaggggaaangccacctctcctgtccggccagtcagagtgtagaagctaacttagcctaggtaacccaagaggacgaccgtggcccagcccctcccgaggcctcctcacttcgtttgattcnctactccgaacgtaggcctaggtagaacctcccagtaccaggtttccgaggtcgccgtaggtgggtcgagggganacggtgttaccnctcacgacactaacacgaacgnggtcgnggcggacgtagttaagttttagtttttagtttttagtttagttagttagtacgtagtagtagttaagttaagtacgttacgtcgttcgttcggtacggtacggtaccggtaccggtaacgggtaacggtaaggtaacggtacgtaacgtaacgtaaacgtaacgtacgtacgtacgtacgaacgtacgtacttacgttcgttacttactactccg

SEQ ID NO: 423102 - DNA, 656 bp, Homo sapiens
  misc_feature: GZ8MTXP02JHSXV.9.27.C05.1.454.CMB.2.raw
  modified_base (202)..(202): a, c, t, g, unknown or other
  modified_base (298)..(298): a, c, t, g, unknown or other
  modified_base (477)..(477): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctcagccgtcctgtctgtgtctccgaggggaaangccaccctctcctggtccgggccagtcagagtgttagaagcaacttagcctggtaaccaacgagacgacctggcccagcccctccaggcctccctnattctttgatgcactccacgtaggccaggtcgaactcccgagacgtaggttcaggtgccgtaggtgggtctagggacagtacgttcacgtcgtcacgactatcaaacgcgcggttacggccgggtagttaggtaaagttttatttttttagtttttaattacgttgttaccgagtttanagttaaatccggtaaagttaccgttcgggtcctttacggttcggtacgggttaaccgtttccgggaaccgtaaacgggggtaaaaccgtaggggttaggacctttaggaaaaccgtaaaacggcgtttagggcggtactacggtccaaacgtctcgttactccgttcctagtttccccc

SEQ ID NO: 423103 - DNA, 723 bp, Homo sapiens
  misc_feature: GZ8MTXP02HTUFI.9.27.C05.1.454.CMB.2.raw
  modified_base (202)..(202): a, c, t, g, unknown or other
  modified_base (255)..(255): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccgaggggaangccaccctctcctgtcggccagtcagagtgtagagcaactgcctggtaccaanagacgaccgtggccacgcccctcccgaggtccctccctctacttcttttaggattcgacctacttaccccgaacggtacggggacccctaagggttaccggaaaccttcccccgaaggtaaccgtacggggtttacaaggggttcggacccgtaggggttcggggtcgtacgggggaactaggtacggtttccaaccttcgtacacggtacaacgtacaaacgtcgacggtcggacgggtcttaaggtaaagtttttgttttttagttttttaattgttgtacgtagtactagttatacgtaagttacgtcgggtacccttggttcggtacggtaccggttaccgggaaccgtaaacggggtaacgtaggggttacgagtttacggaaaccaaaagggttaccgttgggtaccggtactacggaaccctacgacgtttccggatttacccgtcttaactttcccccgg

SEQ ID NO: 423104 - DNA, 643 bp, Homo sapiens
  misc_feature: GZ8MTXP02FZLJL.9.27.C05.1.454.CMB.2.raw
  modified_base (204)..(204): a, c, t, g, unknown or other
  modified_base (266)..(266): a, c, t, g, unknown or other
  modified_base (417)..(417): a, c, t, g, unknown or other
  modified_base (481)..(481): a, c, t, g, unknown or other
tcagtgatacgtctcacgaccggtgctcgatttagacgcgatcgaagggtttgggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaggggaaancgccaccctctcctggtccgggccagtcagtagtgtagaagcaacttgcctaggtaaccaanagacgaccgtcggaccacgccctccgaggcctcctcacttctttgatcgcactccacgtacgggccaaggtggaactcccgagacgtagttcaggtggcgtaggtgggtcgtgggacaggttactcgtactctacgagctaatacaaacgngccggtggcgggtactaggttaagtttagtttttgtttttattacgttgtacgagtctaaagtntagtacttaacggtcgtaccttgtggtacggtacggtttcggaacggtaaacgggtaaccgtagggtacggtacgtaacggtaaacgtaaaacgtacggtaggttcggaccttacggaaccgtaacctacgttccgttactttacctacgtactttcccccg

SEQ ID NO: 423105 - DNA, 602 bp, Homo sapiens
  misc_feature: GZ8MTXP02F545I.9.27.C05.1.454.CMB.2.raw
  modified_base (207)..(207): a, c, t, g, unknown or other
  modified_base (276)..(276): a, c, t, g, unknown or other
  modified_base (384)..(384): a, c, t, g, unknown or other
  modified_base (452)..(452): a, c, t, g, unknown or other
tcagtgatacgtctcacgaccggtgctcgatttagacgcgatcgaaggggtttggggggaggaactgctcagttaggacccagacggaaccatggaagccccagcgcagcttctcttcctcctgctactctggctcccagatatcaatggaagaaatagtaatgacgcagtctccagccgtcctgtctgtgtctccgaaggggaaanagccaccctctcctgtcggccagtcagagtgttagaagcaacttagcctaggtaaccaacgagagaccnggaccagcctcccaggcctcctcatctttgatgcatccagtaggacctaggtagaactccagaccaggttcagtggccgagtgggtctaggggacagagttcaccttncagcctaatacaacgagcgtagccggggataggtaaagtttatttttaggtttttaataagttcgtanaagtataagtaatagtaactaacgttggtaccttacgtggtaggtaccggtcggaaccgaaaggtaacggaaggtaaggtactacgtaacgtaaacgtacggtcgtacgctacgaacgtaccgtactacgttacgtcttacactttcccg

SEQ ID NO: 423106 - DNA, 579 bp, Homo sapiens
  misc_feature: GZ8MTXP01CVKKJ.11.25.C03.1.454.CMB.2.raw
  modified_base (189)..(189): a, c, t, g, unknown or other
  modified_base (259)..(259): a, c, t, g, unknown or other
  modified_base (497)..(497): a, c, t, g, unknown or other
tcagcgagagataccacgaccggtgctcgatttagtagtgtagatttgggtttggggagaggagcccagcactgggattccgaggtgtttccatcggtgatcagcactgaacacagaggactcaccatggagttttggctgagcgtggtttcgtgtaggctatttaaaggagtcagtgtgaggtgcgtntggtggagtctggaggaggcctgatccagcctggggggtccctgagactctcctgtgcagctctgggtcntcgtcatcacactacatgtaggtcggtccgcgacggcgtcggagggaggggcggtggtaggtggtcttctttattacagcgagtgtagtactatatcgcacgaacgtcgtggacgggacgtactacacactctacagacgaacaactactaagaacgacgtacttactttacttactaataacgaacgacgacgtacgagacgacgacgacgacgacggtacgtcgtattacgtgtgngagaggacggcgggaccgaacgttaacgttacgttacgtaacgtagtcggtacggtcggttacgggtaacggaacgggaacg

SEQ ID NO: 423107 - DNA, 541 bp, Homo sapiens
  misc_feature: GZ8MTXP01CVDO0.11.25.C03.1.454.CMB.2.raw
  modified_base (359)..(359): a, c, t, g, unknown or other
  modified_base (392)..(392): a, c, t, g, unknown or other
  modified_base (423)..(423): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgtggtatcaacagaagccaggccagtcccctgtattggtcatctatcaagatgtgaagcggccctcagggatcccgtgagccgattctctggcctaccaactcgtgggaacncagccactctgaccatcagcggaccaggctagngatgagctgactattatgtcaggcgtggacngcagcactcgcccgttaatcgttcgtttccggaacgttacgggacccttaaaggggttccaacccggttcgttacggtaacgttaccgacggaccccaacgggccccgtaaacccccg

SEQ ID NO: 423108 - DNA, 569 bp, Homo sapiens
  misc_feature: GZ8MTXP01EDBLX.11.25.C03.1.454.CMB.2.raw
  modified_base (291)..(291): a, c, t, g, unknown or other
  modified_base (354)..(354): a, c, t, g, unknown or other
  modified_base (365)..(365): a, c, t, g, unknown or other
  modified_base (488)..(488): a, c, t, g, unknown or other
  modified_base (519)..(519): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctatttaaaggagtccagtgtgaggtgcgtctggtggagtctggaggaggcctgatccagcctgggggtccctgagactctcctgtgcagcctctgggttcaccgtcagtcacacctacatgagttggccnccaggctcgaggggagggctggagtggtcttcctttatttacagcagtggtagtacatatcgnagactccgtgnggggccattcacatctcagacgacaactacgaagaacacgtcttgtttactacaaatcgaaacagcctggggaagacgaccgatcgaacgaccgggtccgtagttattaactggtgcgaaggngagtcgggggccccaaaggtaaccgtttacncggctaagtgggaacgttcggcgggggacctaaacggggccctaaccggg

SEQ ID NO: 423109 - DNA, 542 bp, Homo sapiens
  misc_feature: GZ8MTXP01DKSY9.11.25.C03.1.454.CMB.2.raw
  modified_base (296)..(296): a, c, t, g, unknown or other
  modified_base (360)..(360): a, c, t, g, unknown or other
  modified_base (368)..(368): a, c, t, g, unknown or other
  modified_base (370)..(370): a, c, t, g, unknown or other
  modified_base (385)..(385): a, c, t, g, unknown or other
  modified_base (388)..(388): a, c, t, g, unknown or other
  modified_base (416)..(416): a, c, t, g, unknown or other
  modified_base (420)..(420): a, c, t, g, unknown or other
  modified_base (422)..(422): a, c, t, g, unknown or other
  modified_base (425)..(425): a, c, t, g, unknown or other
  modified_base (427)..(427): a, c, t, g, unknown or other
  modified_base (429)..(429): a, c, t, g, unknown or other
  modified_base (438)..(438): a, c, t, g, unknown or other
  modified_base (458)..(458): a, c, t, g, unknown or other
  modified_base (460)..(460): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagtggccnccaggctccgaggggaagggctggagtgggtctcctttatttacagcagtggtatacatatcgnagactcgngngggccatcaccatcncanagacaatcaaagaacagctgtttctaanaaananaanancngagagcganagacgacgcgtagtatatgngngaagagagcggaccgaaccgtaacgttaacgttacgacgtaagtggtaacggtcggtacgggaccggaacggaaccgaaccg

SEQ ID NO: 423110 - DNA, 514 bp, Homo sapiens
  misc_feature: GZ8MTXP01BVTYC.11.25.C03.1.454.CMB.2.raw
  modified_base (451)..(451): a, c, t, g, unknown or other
  modified_base (507)..(507): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttctggatcagcagaaggcaggccagccccctgtccctactcatcttacaaaatccaggccgcctcgtcggggtccctgacgcgtatctccggctccggctctgggaacacacgtcactctcgaccatcagcgggacccagctatgatgagctgtctacttctgtcaggcgtggacacgagcgtggtgtcgggcggtaagggaccnggtcttggtacccgtcgttacggttcacgcccaagggcctcggccccttcggtccncgttccg

SEQ ID NO: 423111 - DNA, 557 bp, Homo sapiens
  misc_feature: GZ8MTXP01AYWB3.11.25.C03.1.454.CMB.2.raw
  modified_base (361)..(361): a, c, t, g, unknown or other
  modified_base (372)..(372): a, c, t, g, unknown or other
  modified_base (469)..(469): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaagggctggagtgggtctcctttatttacagcagtggtagtacatattcgnagactccgtgnggggccattcaccatctccagagacaactctaaagaacacgctgtttctacaaatgaaacagcctgggagagccgatgacacggccgtgtattacgngtgcgaagagagtcgggggacccaaggtaacgttacgcgcctaagtcgggaacgttcggcgggggaccaacggggttcccgaaccggg

SEQ ID NO: 423112 - DNA, 563 bp, Homo sapiens
  misc_feature: GZ8MTXP01DA60A.11.25.C03.1.454.CMB.2.raw
  modified_base (363)..(363): a, c, t, g, unknown or other
  modified_base (374)..(374): a, c, t, g, unknown or other
  modified_base (387)..(387): a, c, t, g, unknown or other
  modified_base (477)..(477): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaagggctggagtgggtctcctttatttacagcagtggtagtacatatcgnagactccgtgngggcatcacatcncagagacaactctaaagaacacgcttgtttctacaaaatgaaacagcctaggggacgagaccgatcgaaccacggccgtagtacttacgngtgacgaagagagtcggggacccctaacggtaacgttacgacgctaagtggccgtcgtgggggaccctaaagggggccctaacggg

SEQ ID NO: 423113 - DNA, 496 bp, Homo sapiens
  misc_feature: GZ8MTXP01BUGUL.11.25.C03.1.454.CMB.2.raw
  modified_base (427)..(427): a, c, t, g, unknown or other
  modified_base (472)..(472): a, c, t, g, unknown or other
  modified_base (475)..(475): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagccgattctctggctccaactctgggaacgcagccactctgacccatcagcgggacccaggctatggatgagctgactattatgtcaggcgtgggacagcngcactgcccgttaatgttcttcggaactgggaccaggttcacgtntgngtcagcccaaggccaaccccg

SEQ ID NO: 423114 - DNA, 540 bp, Homo sapiens
  misc_feature: GZ8MTXP01EZNLK.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcgagggactccctgagccgattctcgtggcctaccaactcgtgggaaacgcacgccactctcgaccatcagcggaccaggctagtgatgagctgactagttattgtcaggcgtgggacagcagcacgtcgcccgttaatcgttcgtcggaacgttcggggaacccttaagggttccacccggttcttggaacgtccgacggaccccgaacgggccccaaacccccg

SEQ ID NO: 423115 - DNA, 651 bp, Homo sapiens
  misc_feature: GZ8MTXP01DV19Z.11.25.C03.1.454.CMB.2.raw
  modified_base (302)..(302): a, c, t, g, unknown or other
  modified_base (377)..(377): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgactccagccgtggggggtccctgagactctctgtgcagcctcgtgggttcaccgtcagtcacacctacatgagttcgggtccnccgaggctccgagggggaaggggctgggaggtcgggtcttcctttatttacagcagtggtagtacatacttccgnacgacctccggtggaacgggggccctaattccacctatcctaccgaagacgaactaactactaaagaaccacgtcttgtttactacgaaatcgaaacagcctaggaagcgaccgatcgaaccgacggtccgttagtacttacgtggtgcggaagacggacgtaccgggggacccctaaacggtaaacccgttttacgaccggttacgttaacggttcggggaaccggttccgggtacggggggaccctaaacgggggaaccccgtaacccgggg

SEQ ID NO: 423116 - DNA, 564 bp, Homo sapiens
  misc_feature: GZ8MTXP01AZW7T.11.25.C03.1.454.CMB.2.raw
  modified_base (295)..(295): a, c, t, g, unknown or other
  modified_base (359)..(359): a, c, t, g, unknown or other
  modified_base (439)..(439): a, c, t, g, unknown or other
  modified_base (492)..(492): a, c, t, g, unknown or other
  modified_base (517)..(517): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaggagtccagtgtgaggtgcgtctggtggagtctggaggaggcctgatccagccgtgggggtccctgagactctcctgtgcagcctctgggttcaccgtcagtcacacctacatgagttgggccnccaggctccgaggggaagggctggagtggtctcctttatttacagcagtggtagtacatatcgnagactccgtgcggggccattcaccatctccagacgacaactactaaagaaccacgtcttgttttacctacaaatgaaacngaccctaggacgagcccgatgaccacggcctaggtattacgtgtgcgaagagngtcggggacccaacggaacgttacncgctaagtcggaaccgtcggcgggggacctaacgggccctaaccggg

SEQ ID NO: 423117 - DNA, 540 bp, Homo sapiens
  misc_feature: GZ8MTXP01DB8KQ.11.25.C03.1.454.CMB.2.raw
  modified_base (362)..(362): a, c, t, g, unknown or other
  modified_base (372)..(372): a, c, t, g, unknown or other
  modified_base (393)..(393): a, c, t, g, unknown or other
  modified_base (471)..(471): a, c, t, g, unknown or other
  modified_base (473)..(473): a, c, t, g, unknown or other
  modified_base (475)..(475): a, c, t, g, unknown or other
  modified_base (480)..(480): a, c, t, g, unknown or other
  modified_base (506)..(506): a, c, t, g, unknown or other
  modified_base (511)..(511): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtgggtttcttgttgctatttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaagggctgggagtgggtctcctttatttacagcagtggtagtacatattcgnagactcgtgnggggccattcacatctcaganacaactctaaagaacacgcttgtttctacaaatgaacagcctggagagccgaatcgaacacggccgtagtatttacgngngngaagngagcgggaccaagtaacgttacgcgntaagnggcgtcggcggggaccaacgggccgaacg

SEQ ID NO: 423118 - DNA, 575 bp, Homo sapiens
  misc_feature: GZ8MTXP01BOSUW.11.25.C03.1.454.CMB.2.raw
  modified_base (363)..(363): a, c, t, g, unknown or other
  modified_base (374)..(374): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccgaggggaagggctggagtgggtcttctttatttacagcagtggtagtacatattccgnagactccgtgnggggccattcaccatctccagagacaactctaaagaaccacgtcttgtttctacaaattgaacagcctgggagagccgatgacacggcgtagtattactggtgcggaagaggacgtcgggggcccctaaacggtaacgtttaccgacggctaagtggggaaccgttcggcggggggaccctaacgggggcccgtaaccggg

SEQ ID NO: 423119 - DNA, 583 bp, Homo sapiens
  misc_feature: GZ8MTXP01ECWJ1.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttgtatcaacagaagccaggccagtcccctgtattggtcatctatcaagatgtgaagccgccctcgagggactcccgtggacgtccgtactttcgtcgtcggcccttaacccaaactccgtaggggaaacccgccaacgcccctactcgtacgacccatccgacggccgggaaccccaggtcctagtggagtggacggtctagtaacttagtttaagttggtacgagggtccgtgggacagcagcctacgtcgtccgttaatcgttcgttacggacgtcggacgaacggttcaccgttctgaacgtcgacgacccgaacggcccctaaccccg

SEQ ID NO: 423120 - DNA, 583 bp, Homo sapiens
  misc_feature: GZ8MTXP01DVGSH.11.25.C03.1.454.CMB.2.raw
  modified_base (237)..(237): a, c, t, g, unknown or other
  modified_base (264)..(264): a, c, t, g, unknown or other
  modified_base (370)..(370): a, c, t, g, unknown or other
  modified_base (541)..(541): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgaganataaatatacttgttgatcaacagaancagccagtccctgtatgcatctatcaagatgtgaagcggccctcgagggactcccgtgacgtccgatttctcgtcggcctaacccaaacttcgtacggggaaaccnccacgccccaactcgtacgacccatccgacggccgggacccagggctagtggatgaggctagacttagtttagttgtcgagggtcgtagggacaggacagtcacgtcgtccccgtttaatcgttcgttaccggaaacgttcggggaaccttaaggggttccttaaccggtnttaggaacgtccgacgttacccgaaacggccccgtaaacccc

SEQ ID NO: 423121 - DNA, 570 bp, Homo sapiens
  misc_feature: GZ8MTXP01EQHLK.11.25.C03.1.454.CMB.2.raw
  modified_base (375)..(375): a, c, t, g, unknown or other
  modified_base (486)..(486): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccgaggggaagggctggagtgggtctcctttatttacagcagtggtagtacatattcgcagacctccgtggnggggccattcaccatctccagagacaactctaaagaacacgcttgtttctacaaatgaaacagcctagggagacgccgaatcgacacggtccgtgtattactgtgcgaagngagtcgggggcccaacggtaaacgttcgttacgcgtaagtgggaaccgtcgtcggggggacccaaacggggaaccctaaccggg

SEQ ID NO: 423122 - DNA, 547 bp, Homo sapiens
  misc_feature: GZ8MTXP01D5QJG.11.25.C03.1.454.CMB.2.raw
  modified_base (322)..(322): a, c, t, g, unknown or other
  modified_base (363)..(363): a, c, t, g, unknown or other
  modified_base (468)..(468): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtcccgtgtccccaggacagacagccagaactcccctgctctggaattgaattgagagataaatatattgtgtatcaacagaagcaggccagtcccctgtattggtcatctatcaagatgtgaagccgccctgaggactcccngagccgtattctcgtggcctacccaactcgtagggaaaccncacgcccactctacgaccatcgacggccgggacccaggctagtggatgagctagtacttagttattggtcgaggtcgtgggacaggcagtactcgtccgttcgtnttcgttcgtaacggacggtacggaacgttcggttcttccgtgtacgcgtacgaccgaccgtaaccgaacccgtaacccg

SEQ ID NO: 423123 - DNA, 618 bp, Homo sapiens
  misc_feature: GZ8MTXP01D70BX.11.25.C03.1.454.CMB.2.raw
  modified_base (260)..(260): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctntgggtccaccgtcagtcacacctacatggagttgggccgccgaggctccgagggggagggctgggagtggttctcctttatttacagcagtggtatacattatcgcagaccgtccgtggaacggggcctaattccaccatcctaccagacaactaactacaaagacacgtcttgtttactacaaatgaacagcctagggagacggccgaatcgaaccgacgggtccgttagtaactttccgtaggtcgacggaaggaacggacggtccgggggaccccaaaggtaaccgttacgttacgaccgtaagtcgggtaaccgtcgggtacgggggacccgtaaacgggggccctaacccggg

SEQ ID NO: 423124 - DNA, 533 bp, Homo sapiens
  misc_feature: GZ8MTXP01EJ1ZZ.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagtagataaatatacttgttggtatcaacagaagcaggccagtcccctgtattggtcatctatcaagatgtgaagccggccctcgagggactcccgtgagccgattctcgtggcctaccaactcgtgggaacgcacgccactctcgaccatcgagccggacccaggctagtggatgagctgactagttattgtcgaggcgtggacaggcagcacgtcgcccgttaatcgttcgttcggaacgtcgggaaccacggttccaccgtcgttgaacgtcacgaccccgaacggcccctaaccccg

SEQ ID NO: 423125 - DNA, 646 bp, Homo sapiens
  misc_feature: GZ8MTXP01EIJ9A.11.25.C03.1.454.CMB.2.raw
  modified_base (284)..(284): a, c, t, g, unknown or other
  modified_base (296)..(296): a, c, t, g, unknown or other
  modified_base (359)..(359): a, c, t, g, unknown or other
  modified_base (371)..(371): a, c, t, g, unknown or other
  modified_base (528)..(528): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtcagtgtgaggtgcgtctggtggagtctggaggaggcctgatccagccgtggggggtccctgagactctcctgtgcagcctcgtgggttcaccgtcagtcacacctanatgagtgggccncgaggctcgaggggaggctggagtggtcttctttatttacagctagtggtatactatactcgnagtacctccggnggcggggctattccacctatacctaccgaagacaacctaaacttcgaaaacggaaccacgttctttagttttaccaacgaaaattcgaaacagtcccgtaggggaaagacggacccaagtcgaaaccgtccgggtccgttaagttaacgtttacggnggtacggaacggaaggacgggacgggtacccgggaaccctaaacggttaaccgttacgcggttacgtaaggacggtcggtcgggacgggaacccgtaaacgggttaacccgtaaccgg

SEQ ID NO: 423126 - DNA, 546 bp, Homo sapiens
  misc_feature: GZ8MTXP01B6W8P.11.25.C03.1.454.CMB.2.raw
  modified_base (297)..(297): a, c, t, g, unknown or other
  modified_base (360)..(360): a, c, t, g, unknown or other
  modified_base (371)..(371): a, c, t, g, unknown or other
  modified_base (502)..(502): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccnccaggctccgaggggagggctggagtgggtctcctttatttacagcagtgtagtacatatcgnagactccgtgnggggccattcacatctccagagacaactcaaagaacacgtcttgtttctacaaatgaacagcctgggagagccgatcgacacggctagtattactgtgcgaagagatcgggggacccaacggaacgttacncggctaagcgggaacgtcgagggggccaagggggcctaaccggg

SEQ ID NO: 423127 - DNA, 581 bp, Homo sapiens
  misc_feature: GZ8MTXP01CW73A.11.25.C03.1.454.CMB.2.raw
  modified_base (296)..(296): a, c, t, g, unknown or other
  modified_base (373)..(373): a, c, t, g, unknown or other
  modified_base (505)..(505): a, c, t, g, unknown or other
  modified_base (509)..(509): a, c, t, g, unknown or other
  modified_base (514)..(514): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtggtttctgtgctatttaaaaggagtcagtgtgaggtgcgtctggtggagtctggaggaggcctgatccagccgtgggggtccctgagactctcctgtgcagcctcgtggggttcaccgtcagtcacacctacatgagttcgggtccnccaggcctccgaggggaaggggctgggaggttgggtcttcctttaatttacagcaggtggtagtacattacttccgnagtacctccggtggcgggggcctattccaccatcctacagacacaactcaaagaccacgtcttagtttactacaaattcgaacacgcctagggaacgacgccgaatcgaccgacggtcgttagtacttacgngtgngaagngacggtccggacctaaacgtacttacgttcgacgtaagcggtcgtcggcgggacgaacgggcctcgg

SEQ ID NO: 423128 - DNA, 574 bp, Homo sapiens
  misc_feature: GZ8MTXP01AGUHY.11.25.C03.1.454.CMB.2.raw
  modified_base (438)..(438): a, c, t, g, unknown or other
  modified_base (488)..(488): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccgaggggaagggctggagtgggtctcctttatttacagcagtgtagtacatattcgcagactccgtggcggggccattcaccatctaccagacgacaactctaagaacacgtctgtttctacaaattcgaaacngcctagggacgacgcccgaagtcgaccgaccgggccgttagtacttacgngtgcggaagagagtccgggggacccaacgtaacgttcacgctaagtgggaaccgtcggtcggggacccaaggggcccgtaaccggg

SEQ ID NO: 423129 - DNA, 583 bp, Homo sapiens
  misc_feature: GZ8MTXP01EFRJ5.11.25.C03.1.454.CMB.2.raw
  modified_base (269)..(269): a, c, t, g, unknown or other
  modified_base (373)..(373): a, c, t, g, unknown or other
  modified_base (470)..(470): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtcccgtgtccccaggacagacagccagaactcccctgctctggaattgaattgagagaataaatattacttgttggtatcaacagaanccaggccagtcccctgtatggtcatctatcaagatgtgaagccggccctcgagggactcccgtgacgccgtattctcgtggcctacccaactcgtacggggacncacgccatctagacccatcgacggccggacccgaggactagtggagtagacggtctagtactttagttagttcggtacacgggtcggaggggaaccngacgacgtcgtacgtcgtccgttaagtcgttaccggtacggttaacgtacgggaaccgttacggttccttaccgtctacggaacgtcgaccgacccgtaaccgccctaacccg

SEQ ID NO: 423130 - DNA, 634 bp, Homo sapiens
  misc_feature: GZ8MTXP01BNQ3P.11.25.C03.1.454.CMB.2.raw
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtatgtcatctatcaagatgtgaagccggccctcgagggactcccgtggacgccgtacttctctcggcctacccaaacttcgtaggggaaaccgccacgccccaacttcgtacgacccagtccgacgggccgggaaccccgagggtaccctaagtgggatcgggacggcttaggtaaccttaagtttagtttcgggtacgtaacgggtccggtacggggaaccgaggccaaggtccaacgtcggtccccgttaagttcgttccggttacggaacgtcggggtaacccttaagggttccaacccggttcttaggaacgtcgacccggacccgtaaaccggccccgtaaaccccccg

SEQ ID NO: 423131 - DNA, 593 bp, Homo sapiens
  misc_feature: GZ8MTXP01ECQOI.11.25.C03.1.454.CMB.2.raw
  modified_base (300)..(300): a, c, t, g, unknown or other
  modified_base (343)..(343): a, c, t, g, unknown or other
  modified_base (362)..(362): a, c, t, g, unknown or other
  modified_base (427)..(427): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttgggtccnccaggctccgaggggagggctggagtggtctcctttatttacngcagtgtagtacatatcgnagactccgtgcggggcattcaccatctccagacgacaactctaaagaacacgtcttgtttactanaaatgaaacagccctggggaagagtccgatcgaacgacggccgtagtattacgtggtcgcggaaggagttacggtcgggggaccccaaacggtaaacgttaccgttacgcgttaagtcgggtaaccggtcggtacgggggaccctaacggggaaccctaaccgggg

SEQ ID NO: 423132 - DNA, 574 bp, Homo sapiens
  misc_feature: GZ8MTXP01B7CN2.11.25.C03.1.454.CMB.2.raw
  modified_base (340)..(340): a, c, t, g, unknown or other
  modified_base (398)..(398): a, c, t, g, unknown or other
  modified_base (424)..(424): a, c, t, g, unknown or other
  modified_base (433)..(433): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttggtccgccaggctccgaggggagggctggagtgggtctcctttatttacngcagtggtagtacatacttcgcagactccgtggcggggccaattcaccatctccaganacaactcaagacacgcttgtttctanaaatgaacngcctggggacgagccgatcggacgacggccgttgtacttacgtgtacgcggaagaggagtcgggggccctaaacggaaccgtttacgttcgcttaagtcgggtaacgtcggtcgggggaccctaaggggcccgtaaccggg

SEQ ID NO: 423133 - DNA, 561 bp, Homo sapiens
  misc_feature: GZ8MTXP01A5D6G.11.25.C03.1.454.CMB.2.raw
  modified_base (277)..(277): a, c, t, g, unknown or other
  modified_base (295)..(295): a, c, t, g, unknown or other
  modified_base (335)..(335): a, c, t, g, unknown or other
  modified_base (354)..(354): a, c, t, g, unknown or other
  modified_base (386)..(386): a, c, t, g, unknown or other
  modified_base (400)..(400): a, c, t, g, unknown or other
  modified_base (413)..(413): a, c, t, g, unknown or other
  modified_base (416)..(417): a, c, t, g, unknown or other
  modified_base (469)..(469): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtgttaggctatttaaaggagtcagtgtgaggtgcgtctggtggagtctggaggaggcctgatccagccgtggggggtccctgagacctctcctgtgcagcctctgggttcaccgtcagtcacncctacatgagttgggccncaggctcgaggggagggctgggagtggtctctttattacngcagtggtatcatactcgnagactcgtggcggggcattcaccatcacaganacaactcaagaacngtcttgttctaanaannacacgacgacggagacgacgacgacgacgacggtcgtacgtacgtagtgtgngaagaggacggtcggaccgtaaccgtaacgttacgttacgttacgtaacgtcggtcggtcggtacgggaccggtaaccggaaccggtaaccg

SEQ ID NO: 423134 - DNA, 585 bp, Homo sapiens
  misc_feature: GZ8MTXP01A80GO.11.25.C03.1.454.CMB.2.raw
  modified_base (360)..(360): a, c, t, g, unknown or other
  modified_base (452)..(452): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagtgggccgccaggctccgaggggagggctggagtgggtctctttattacagcagtggtagtacatatccgnagacctccgtggcggggccgatcaccatctccagacgaacaactctaaacgaacacgtcttgtttaccttacaaatgaaacagcctgggganacggccgatcgaccacggtccgtagtacttacgtgtgcggaagaggacgtcgggggccctaacgggtaaccgttacgacgctaaggtgggtaaccgtcggtcgggggaccctaaacgggggcccgtaaccggg

SEQ ID NO: 423135 - DNA, 612 bp, Homo sapiens
  misc_feature: GZ8MTXP01DT2U9.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaacgcgggccctacgagggactccccgtgaacggccgatttcgtctcggcctaaccccgaaacttccgtggggaaaccgccaacgcccactctagacccagtcacggccgggaacccctaggactagtgggatgaggctagacttagttattgtcgagggtcgtggacagaccaggtccaaccgttcgccccgtttaagtcggttccgttacggggaaaccgtcgggggtaacccaaacggggttccaacccggtttcgtacggtaacggtaccacggacccctaaaccgggcccctaaaacccccg

SEQ ID NO: 423136 - DNA, 572 bp, Homo sapiens
  misc_feature: GZ8MTXP01AJ1N8.11.25.C03.1.454.CMB.2.raw
  modified_base (298)..(298): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccnccaggctccagtgaaggggctggagtgggtctcctttattacagcagtggtataccatatccgcagaacctccgtgaggggccattcaccatctccagagacaactctaaagaacacgcttagtttactacaaaatcgaaacaggccctaggacgagacccgaatcgaccgaccgggccgttgtaacttactggtgcgagaggacgttcgggggacccctaagaacgtttcacgctagtcgggacgtcggttcgggggccaacgggggaacccc

SEQ ID NO: 423137 - DNA, 562 bp, Homo sapiens
  misc_feature: GZ8MTXP01EO5LK.11.25.C03.1.454.CMB.2.raw
  modified_base (517)..(517): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcgagggtactcccgtgagccgattctcgtggccctacccaaactccgtagggaaaccgcacgcccactctcgacccatcacgcggacccaggctagtgatgaggctagacttatttattggtcagggtcgtggacagacagcactcggcccttaagtcgttcgttcggaaacgtcgggaacgttaacggttccaacccggttnttacggaacggttacacggaccctaaaccgggccccaaacccccg

SEQ ID NO: 423138 - DNA, 572 bp, Homo sapiens
  misc_feature: GZ8MTXP01AWBUR.11.25.C03.1.454.CMB.2.raw
  modified_base (438)..(438): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttcgggtccgccgaggcctccgaggggaagggctggagtgggtcttctttatttacagcagtgtagtacatatcgcagactccgtgcggggccattcaccatctcagacacaactcaaagaacacgtcttgtttctacaaatcgaaacngcctagggacgacgccgatcgaccgacggtccgttagtattacgtgtgcgaagagcggtcggggacccaaaggtaaccttacgcgctaagtcgggaacgttcgggacgggggaccaacggggcccgtaaccggg

SEQ ID NO: 423139 - DNA, 749 bp, Homo sapiens
  misc_feature: GZ8MTXP01BXKD4.11.25.C03.1.454.CMB.2.raw
  modified_base (316)..(316): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaatgagagataatatattgtgatcaacagaagcaggccagtccctgtatgtcatctatcaagatgtgaacgcgccctgaggactcccngacgccgtatttctcgtcggcctaacccaacttcgtacgggaaaccgccacgccctaactccgtacgaaccctacgtaccgaacgggccggggaacccccaagggtacccttaagtcggggaacgttaggaacggggtccttaaggtaaacctttaaggttttaagtttacgggtaccgtaacgggggtccggggttacgggggaacccaaggggtacccgaaacgggtcccctaaccggttaccgggtccccgggttttaaagttcgggtttaccccggttttaccgggggaaaacccggtttacggggggaaaccccgttaaaccgggggttcccgttaaccccgggtttaacgttttccgggaacgggtttacccgaaaccggggttacccccccgtaaaacgggggaacccccccgtaaaacccccccg

SEQ ID NO: 423140 - DNA, 588 bp, Homo sapiens
  misc_feature: GZ8MTXP01BV2ZO.11.25.C03.1.454.CMB.2.raw
  modified_base (298)..(298): a, c, t, g, unknown or other
  modified_base (360)..(360): a, c, t, g, unknown or other
  modified_base (394)..(394): a, c, t, g, unknown or other
  modified_base (560)..(560): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagtgggtccnccgaggctccgaggggaggcgtggagtggtctcctttattacagcagtggtatacatatcanagactccgtgaacggggcctaattccaccatccnccagacgaacaactactaaagaaccacgtcttagtttctacaaatcgaaacagccctaggggaagcgaccgatcgaccgacggccgtagttattacgtgtagcgaagagacggtcggggaccccaaacggtaactttacgacgccttaagccgggaacgttccggngggggaccctaaacggggcctaaccggg

SEQ ID NO: 423141 - DNA, 563 bp, Homo sapiens
  misc_feature: GZ8MTXP01B26B2.11.25.C03.1.454.CMB.2.raw
  modified_base (299)..(299): a, c, t, g, unknown or other
  modified_base (356)..(356): a, c, t, g, unknown or other
  modified_base (364)..(364): a, c, t, g, unknown or other
  modified_base (366)..(366): a, c, t, g, unknown or other
  modified_base (379)..(379): a, c, t, g, unknown or other
  modified_base (384)..(384): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtgggttcaccgtcagtcacacctacatgagttggccncaggctcgaggggaggctggagtggtctctttattacagcagtgtagtacatatcgnagactcgngngggcatcacatcncaganacaactctaagacacgcttgtttactacaaatcgaacagcctaggagagccgatcgacgacggtcgtagtatacgtgtgcgaagagacgtcggggaccccaaaggtaacgtttacgacgttaccgtaaggtcgggtaaccgtcgggtcgggggacccgtaaacggggcccgtaaccggg

SEQ ID NO: 423142 - DNA, 555 bp, Homo sapiens
  misc_feature: GZ8MTXP01BCCR1.11.25.C03.1.454.CMB.2.raw
  modified_base (365)..(365): a, c, t, g, unknown or other
  modified_base (376)..(376): a, c, t, g, unknown or other
  modified_base (391)..(391): a, c, t, g, unknown or other
  modified_base (396)..(396): a, c, t, g, unknown or other
  modified_base (474)..(474): a, c, t, g, unknown or other
  modified_base (486)..(486): a, c, t, g, unknown or other
  modified_base (512)..(512): a, c, t, g, unknown or other
  modified_base (532)..(532): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaagggctgggagtgggtctcctttatttacagcagtggtatacatattccgnagactccgtgngggccattcacatcncaganacaactctaaagaacacgtctgtttctacaaatgaacagcctgggagagccgatcgaacacggccgttagtattacgngtgcgaagtagngtcggggacccaacggtaacgttacncgctaagtcggaacgttcgnggggacccaacggggccaaccgg

SEQ ID NO: 423143 - DNA, 599 bp, Homo sapiens
  misc_feature: GZ8MTXP01EAASJ.11.25.C03.1.454.CMB.2.raw
  modified_base (284)..(284): a, c, t, g, unknown or other
  modified_base (338)..(338): a, c, t, g, unknown or other
  modified_base (358)..(358): a, c, t, g, unknown or other
  modified_base (550)..(550): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaatttaaaaggagtccagtgtgaggtgcgtctggtggagtctggaggaggcctgatccagccgtgggggtccctgagactctcctgtgcagcctcgtgggttcaccgtcagtcacacctanatgagtcgggccgccaggctacgaggggaggctggagtggtcttctttattacngcagtggtatacatactcgnagacctccgtggcgggggccattccaccatcctacaagacgaaccaactactaaagaaccacgtctttagtttactacaaaatcgaaacacgccctaggggaacgacggacccgtaagtcggaaccgacggggtccgttagttacttacgtgtcggcgaaggagacggtcggggacccaaggtaacgttacncgctaagtcgggaacgtcggacgggggacctaacggggcccgtaaccgg

SEQ ID NO: 423144 - DNA, 571 bp, Homo sapiens
  misc_feature: GZ8MTXP01ARJBU.11.25.C03.1.454.CMB.2.raw
  modified_base (370)..(370): a, c, t, g, unknown or other
  modified_base (498)..(498): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggccgccaggctccgaggggagggctggagtgggtctcctttatttacagcagtgtagtacatattcgcagctccgtgngggccattcaccatctcagagacaactcaaagaacacgtcttagttttctacaaaattcgaaacaggccctaggggacgaggcccgagtcgaaccgacgggtccgtagtacttacgtgtgcgaagagngtcgggggcccaacggaacgttacgcgctaagttcgggaacgtcgtcggggaccgaacgggaaccgtaaccgg

SEQ ID NO: 423145 - DNA, 577 bp, Homo sapiens
  misc_feature: GZ8MTXP01BZ7A5.11.25.C03.1.454.CMB.2.raw
  modified_base (197)..(197): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacagaatccatggcctcctatgagttgactcagccaccctccatgtccgtgtcccccgganagacagccaccatcagctgctctggagatgtcttgactaatgagtatgcttcctggtatcagcagaaggcacggccacgccccctgtcctactcattacttacaaaactccgaggccgccctcgtcggggtccctggacgcgtattccgccggcctcccgggctcgtagggaacacgacgtccactctcgaccatcgacgcgggacccaggctatgatgagctgtctacgttctgtcaggcgtggacacgaggcggtggtcggtcgggcggaacggggaccttggttaccgttcggtacccggttcgtttacgggccgttaccggaacccgaacgggtcccttccggccccccgttcgggtaacccttccgtttccccgg

SEQ ID NO: 423146 - DNA, 564 bp, Homo sapiens
  misc_feature: GZ8MTXP01CAUIZ.11.25.C03.1.454.CMB.2.raw
  modified_base (253)..(253): a, c, t, g, unknown or other
  modified_base (273)..(273): a, c, t, g, unknown or other
  modified_base (373)..(373): a, c, t, g, unknown or other
  modified_base (386)..(386): a, c, t, g, unknown or other
  modified_base (389)..(389): a, c, t, g, unknown or other
  modified_base (444)..(444): a, c, t, g, unknown or other
  modified_base (477)..(477): a, c, t, g, unknown or other
  modified_base (487)..(487): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctggaggaggcctgatccagccgtgggggtccctgagactctcctgtncagcctctgggttcaccgtnagtcacacctacatgagttgggtccgcaggctccgaggggaggctggagtgggtctcctttatttacagcagtggtagtacatattcgcagactccgtgnggggccattcacntcnccagacgacaactctaaagaacacgcttgtttctacaaatgaaacagcctggagngcccgatcgaccgacggccgttagtacttacgngtgcggaagngagtcgggggccccaaggtaacgttacgttacgctaagtcggaacgtcgtcgggggaccaaagggttcccgaaccgg

SEQ ID NO: 423147 - DNA, 566 bp, Homo sapiens
  misc_feature: GZ8MTXP01DR4NA.11.25.C03.1.454.CMB.2.raw
  modified_base (355)..(355): a, c, t, g, unknown or other
  modified_base (364)..(364): a, c, t, g, unknown or other
  modified_base (380)..(380): a, c, t, g, unknown or other
  modified_base (449)..(449): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaggagtccagtgtgaggtgcgtctggtggagtctggaggaggcctgatccagccgtgggggtccctgagactctcctgtgcagcctctgggtcaccgtcagtcacacctacatgagttgggtccgccaggctccgaggggaggctggagtggtctctttatttacagcagtgtagtacatattcgnagactccgngcggggccattcaccntctcagagacaactctaagacacgtctgtttctacaaatgaacagcctagggacgagccgaatcgaccncggccgtagtaacttaccgtgtcgcggaagacgcgtcgggggcccctaaaggtaacgttacgcggcctaagtcgggaaccgttcggacgggggacctaaacgggggccctaaccggg

SEQ ID NO: 423148 - DNA, 562 bp, Homo sapiens
  misc_feature: GZ8MTXP01CATTI.11.25.C03.1.454.CMB.2.raw
  modified_base (363)..(363): a, c, t, g, unknown or other
  modified_base (370)..(370): a, c, t, g, unknown or other
  modified_base (373)..(373): a, c, t, g, unknown or other
  modified_base (391)..(391): a, c, t, g, unknown or other
  modified_base (480)..(480): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagtttggctgagctgggtttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctggagtgggtctcctttatttacagcagtgtagtacatattcganagctcgnggngggcatcacatcacaganacaactacaaagaacacgtcttcgtttactacaaaatcgaaacagccgtaggacgacgaccgaatagacgacggcgtagtattatgtgngaagagaggtcgggaccgaacgtaacgttaacgttacgactaagtaggtaacgtcggtcgggaccggaacggaaccgaaccg

SEQ ID NO: 423149 - DNA, 633 bp, Homo sapiens
  misc_feature: GZ8MTXP01CGMJ9.11.25.C03.1.454.CMB.2.raw
  modified_base (300)..(300): a, c, t, g, unknown or other
  modified_base (449)..(449): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggtccnccgaggctccgaggggagggctggagtggtctcctttattacagcagtggtagtacactattcgcagacctccgtggcggggcctattcaccatcctccagacgacaactctaaagaacacgtcttgttttactacaaaatcgaaaccncgtaccgtaggggaacgacgacccgtaagtaccgaaccgaccggtaccgttagttaacttacgtggtacgacggtaaggacggttacgggtaccggggacccctaaacggtaaccgtttaaccgcgttacgttaaggtacgggtaaccgtcggacggggaaccgtaacgggaacccgtaaccgg

SEQ ID NO: 423150 - DNA, 598 bp, Homo sapiens
  misc_feature: GZ8MTXP01DT9B3.11.25.C03.1.454.CMB.2.raw
  modified_base (383)..(383): a, c, t, g, unknown or other
  modified_base (412)..(412): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctatttaaaggagtccagtgtgaggtgcgtctggtggagtctggaggaggcctgatccagccgtgggggtccctgagactctcctgtgcagcctcgtgggttcaccgtcagtcacacctacatgagttggccgccaggctccgaggggaggctggagtggtctctttattacagcagtgtagtacatatcgcagactccgtgcggggcattcacatctcaganacaactcaagacacgtcttgtttcctaanaatcgaacacgtccgtagggacgacgaccgagtacgaccgcggtccgttagttacttacgtggtacggcggaaggtacggttacgggtacccggggaaccctaaacggttaaccgttaccgttacggttcgtaaggtcgggtaaccggttcgggacggggacccgtaacggggaacccgtaaccgg

SEQ ID NO: 423151 - DNA, 532 bp, Homo sapiens
  misc_feature: GZ8MTXP01D086Q.11.25.C03.1.454.CMB.2.raw
  modified_base (200)..(200): a, c, t, g, unknown or other
  modified_base (227)..(227): a, c, t, g, unknown or other
  modified_base (484)..(484): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacagaatccatggcctcctatgagttgactcagcccaccctccatcgtccgtcgtcccccgganagacagccaccatcagctgctctgganatgtcttgactaatgagtatgcttctggtatcagcaagaaggcaggccacgccccctgtccctactctattcttacaaaatcccaggccggccctcgtcggggtccctggacgcgtattccgtcccggctcccgggctcggcgggaaacacgtagtccactctacgaccatcgacggccggaccaggtctagttgatgagtctgtctacttctgtcagggcgtggacagagcggtggtgtcggcggaaggcagtcgngacgtcgttagttcacgccgagccgtcgccccgttgtccgttcgtccg

SEQ ID NO: 423152 - DNA, 609 bp, Homo sapiens
  misc_feature: GZ8MTXP01AF99D.11.25.C03.1.454.CMB.2.raw
  modified_base (363)..(363): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggatccctgagccgattctctggcctaccaactctgggggaaacccncacgccctactcgtacgacctagtaccgacgggaccggacccgaggactagtggagtaggacggtctagtaactttaggtttacgttcggtacgacgggtcggtagggaacaggacgacgtaccgtaccgtccggtacccgttaagtcggttaccggttaccggttaacggtaccgggtaaccgttacggttaccgttccgttcgtacgtaacgtaccgaccgacccgaaccgaaccccgaacccc

SEQ ID NO: 423153 - DNA, 553 bp, Homo sapiens
  misc_feature: GZ8MTXP01AXC9X.11.25.C03.1.454.CMB.2.raw
  modified_base (394)..(394): a, c, t, g, unknown or other
  modified_base (478)..(478): a, c, t, g, unknown or other
  modified_base (509)..(509): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccaggcctggggggtccctgagactctcctgtgcagcctctgggttcaccgtcagtcacacctacatgagttgggtccgccaggctccgaggggaagggctggagtgggtctcctttatttacagcagtggtagtacatatcgcagactccgtggaaggggccgattcacatcnccagagacaactctaaagacacgctgtttctacaaatgaacagcctgggagagccagtgacacggccgtagtattacgtgtcgngaagagagtcggggcccaacggaacgttacncgctaagtggaacgtcgtcggggaccaacggggaaccgaaccgg

SEQ ID NO: 423154 - DNA, 624 bp, Homo sapiens
  misc_feature: GZ8MTXP01EV9UP.11.25.C03.1.454.CMB.2.raw
  modified_base (348)..(348): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtggggggtccctgagactctctgtgcagcctcgtgggttcaccgtcagtcacacctacatgagttcgggtccgccgaggctccgaggggaaggggctggaggtggtcttcctttatttacngcagtgtagtacattactccgcagacctccggtggaacgggggcctattccaccctattcctaccgagacgaacaaactctaaagaaccacgtcttgttttactacaaatcgaacagccctaggggagacgaccgatcggaaccgcgggtccgttaggttacttacgtgggtcgcgggaaggagttacggtccgggggacccctaaacggtaaaccgttacgttacgcttaagtgggaacgttcggacgggggaccaacggggttcccgaaccggg

SEQ ID NO: 423155 - DNA, 621 bp, Homo sapiens
  misc_feature: GZ8MTXP01EE3VJ.11.25.C03.1.454.CMB.2.raw
  modified_base (307)..(307): a, c, t, g, unknown or other
  modified_base (534)..(534): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccgagccgtgggggtccctgagactctctgtgcagcctcgtcgggttcaccgtcagtcacacctacatgagttcgggccnccgaggcctccgagggggaagggcgtggaggttgggtcttcctttatttacagtcaggtgtagtacatacttcgcagacctcggtgcggggcattcacctatctacgagacgacaactacaaagaacacgtacttcgtttactacaaattcgaaacagcctaggggaacgacgcccgaatcgaaccgtaccggccgttagtaacttacgtagtcgacggaagacggnggtacgggacccaaacggtaacgttacgttacgctaaggtcgggtaaccgttcggcgggggacccgaacgggaacccgtaacccggg

SEQ ID NO: 423156 - DNA, 606 bp, Homo sapiens
  misc_feature: GZ8MTXP01A52HB.11.25.C03.1.454.CMB.2.raw
  modified_base (300)..(300): a, c, t, g, unknown or other
  modified_base (311)..(311): a, c, t, g, unknown or other
  modified_base (319)..(319): a, c, t, g, unknown or other
  modified_base (354)..(354): a, c, t, g, unknown or other
  modified_base (372)..(372): a, c, t, g, unknown or other
  modified_base (379)..(379): a, c, t, g, unknown or other
  modified_base (391)..(392): a, c, t, g, unknown or other
  modified_base (397)..(397): a, c, t, g, unknown or other
  modified_base (399)..(399): a, c, t, g, unknown or other
  modified_base (413)..(413): a, c, t, g, unknown or other
  modified_base (419)..(419): a, c, t, g, unknown or other
  modified_base (436)..(436): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagtcttgggttttccttgttgacttaattttaaaaggagtccagtgtgaggtgcgtcgtggtggagtcgtggaggaggcctgactccaggccgtggggggtccctgacgacctctcctgtgcagcctcgtgggttccaccgtcacgtcacacctantgagtcggccnccgaggcncggaggggagggctggagtggtcttctttattacngcagtgtatacatatcgnagctcgngcggctatcacnnctcananacaacactaagacngtcttntttacacaaatcaaacngccgtaggaacgcgaccgatcgactacgggtctagttacttacgtgtcgcgaagacggttaggtccgggggaccctaaacggttaaaccgtttacgcggttaccttaagggtaccgggtaaccggttccgggacgggggaacccgtaaacgggggccccgtaacccgggg

SEQ ID NO: 423157 - DNA, 800 bp, Homo sapiens
  misc_feature: GZ8MTXP01C8F50.11.25.C03.1.454.CMB.2.raw
  modified_base (180)..(180): a, c, t, g, unknown or other
  modified_base (309)..(309): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggngtccagtgtgaggtgcgtcgtggtggagtcgtggaggaggcctgactccagccgtgggggtccctgagactctcctgtgcagcctcgtgggttccaccgtcagtcacacctacatggagttcgggtccnccgaggcctaccggaagggggaacggggcgtggggtaggttcggggttcctttaccgtttttaatttaccgaggtactaggttcgggtaagtacctaattacgttccgacacggtaccgtcccgggtgggaaccgggggccctaaatttcccaaacctacgtacccgtaccaaagggtaacaaaccctaaacttaccgtaaaaggaaaccctacggtaccttttacggttttaccttaaccgaaaagttacggaaactaacgtccccgttaagggggaacggaaccggtaccccgtaagtccggaaacccggaccggtcccggttagttaacgtttaccgttaggtacggaccggaaggtaagggttacggttacccgggggaacccctaaaacgggttaaaccgttaaccgttaccggaaccgtttaaggacggggtccggttacgggtacgggggaacccgtaaacgggggttaacccctaacccgggg

SEQ ID NO: 423158 - DNA, 622 bp, Homo sapiens
  misc_feature: GZ8MTXP01EPBQD.11.25.C03.1.454.CMB.2.raw
  modified_base (265)..(265): a, c, t, g, unknown or other
  modified_base (334)..(334): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactccctgctctggaattgaattgaagagtaataaatattacttgttaggtatcaanagaagccaggccagtccctgtattggtcatctatcaagatgtagaagcccggcctcgagggactcccgngacgccgtatttctctggcctaccaactcgtagggaactcacgcccactctcgaccatccgagccgggacccaggtctagtgatggacgtctagtacttagttgttgtcgagggtcgaggacagacgagtccgaacgttcggtacccgtttaagtcggttaccgttacgggaaaccggttcgggggaaaccccttaaagggggttcccttaacccggggtttcgttacgggtaaaccgttccggaaccggttacccccgtaaaccggggaacccccctaaaacccccg

SEQ ID NO: 423159 - DNA, 643 bp, Homo sapiens
  misc_feature: GZ8MTXP01DF6OQ.11.25.C03.1.454.CMB.2.raw
  modified_base (306)..(306): a, c, t, g, unknown or other
  modified_base (346)..(346): a, c, t, g, unknown or other
  modified_base (367)..(367): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggagggaggcctgatccaggccgtgggggtccctgagactctcctgtgcagcctcgtgggttccaccgtcagtcacacctacatgagttcgggccnccaggctccgaggggaggctggagtggtctctttattacngcagtggtatactactatcgnagactccggtgcggggcctattcacatctacagacacaactctaaagacacgtcttgtttactacaaaattcgaaacacggtaccctaggggaacgtacggtacccttaagtacgaacccgtaccgggtccgtttaagttaacgtttaaccgtgggtacggacggaaggaacggttacgggtaccgggggacccctaaacgggtaaacgtttacgacggttctaaggcggtaaccggtcggtacgggggacccgaaacggggaacccgtaaccggg

SEQ ID NO: 423160 - DNA, 532 bp, Homo sapiens
  misc_feature: GZ8MTXP01COWQX.11.25.C03.1.454.CMB.2.raw
  modified_base (361)..(361): a, c, t, g, unknown or other
  modified_base (373)..(373): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggatccctgagccgattctctggctacccaactcgtggggaaacncacgtccactcncgaccatccaaggccgggaccaggctagtggatggagctgactagttattgtcaggcgtgggcaggcagccactgcccgttaatcgttcgttcggaacgtcggggaaccaagggttccaccgttcgtgtaacgtcacggacccaacggcccaaaccccg

SEQ ID NO: 423161 - DNA, 572 bp, Homo sapiens
  misc_feature: GZ8MTXP01DDZ89.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccgccgaggctccgaggggaagggcgtggagtgggtctcctttatttacagcagtggtagtacatatcgcagactccgtgcggggccattcaccatctccagagacaactctaagaacacgcttgtttctacaaatgaacagcctaggacgagccgatgacgacggccgtagtattacgtgtgcgtaagagagtcgggggaccctaacggtaacgtttacgacgctaagtcgggaaccgttcgcgggggacccgtaacgggggaaccctaacccgggg

SEQ ID NO: 423162 - DNA, 548 bp, Homo sapiens
  misc_feature: GZ8MTXP01COXGI.11.25.C03.1.454.CMB.2.raw
  modified_base (360)..(360): a, c, t, g, unknown or other
  modified_base (412)..(412): a, c, t, g, unknown or other
  modified_base (431)..(431): a, c, t, g, unknown or other
  modified_base (452)..(452): a, c, t, g, unknown or other
  modified_base (466)..(466): a, c, t, g, unknown or other
  modified_base (475)..(475): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccgcaggctccgaggggagggctggagtggtctctttatttacagcagtggtatacatactcgnagactccgtggcgggccattccacatctcagacacaactctaaagaacacgnttgtttctacaaatgaacngcctaggagagccgatcgacncggcgtgtatctgngcgaagagngtccggggacccaacggtaacgttacgcgctaagtcgggaacgtcggtgggggacccaaggggccctaacggg

SEQ ID NO: 423163 - DNA, 602 bp, Homo sapiens
  misc_feature: GZ8MTXP01APK4C.11.25.C03.1.454.CMB.2.raw
  modified_base (370)..(370): a, c, t, g, unknown or other
  modified_base (401)..(401): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggcctccgaggggaaggggctgggagtgggtcttctttatttacagcagtggtagtacactattcgnagacctcggtggcggggccattccaccatcnccagacacaactcaaagacacgtcttgtttctacaaattcgaaacagccctaggggacgacgcccgaatcgaaccgacgggtcccgttagtaacttaccgtggtcgcggaagacggcggtcgggggaccccaaagggtaaccttacgcggttactaagtcgggaacgttcggacgggggacccaaaggggcccctaacggg

SEQ ID NO: 423164 - DNA, 678 bp, Homo sapiens
  misc_feature: GZ8MTXP01DUQ5R.11.25.C03.1.454.CMB.2.raw
  modified_base (180)..(180): a, c, t, g, unknown or other
  modified_base (292)..(292): a, c, t, g, unknown or other
  modified_base (306)..(306): a, c, t, g, unknown or other
  modified_base (348)..(348): a, c, t, g, unknown or other
  modified_base (455)..(455): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagtttggctgagcttgggttttccttgttgcttaattttaaaaggngtccagtgtgaggtgcgtcgtggtggagtcgtggaggaggcctgactccagccgtgggggtccctgacgactctcctgtgcagcctcgtgggtcaccgtcagtcacacctanatgagttcgggccncgaggctacggaggggaggctggagtggtcttctttattacngcagtggtatactatactcgcagacctcggtggcggggcctattccaccatccacagacacaacgtactaaagaactacgtctttagtttactacgaaatcgaaacncgtacccgtaggggaacgtacggacccgtaagtcggaaccgaccgggtaccgtttagttaacgttaccgtggtacggacggtaaggtaacggacgggttcccgggggaacccctaaacgggttaaacccgtttaaccgttacggttaccgttaagggtccgggtaaccgggtttccgggacggggggaaccccgtaaaccgggggttaacccgtaaccccggg

SEQ ID NO: 423165 - DNA, 844 bp, Homo sapiens
  misc_feature: GZ8MTXP01BD3ZA.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgactccgaggccggtcggggggtccctgacgacctctcctgtgcacgtcctcgtgggtcaccgtcagtccacacctacatgaggttcgggcccgccaggctccggaagggggaacggggcgtggggtaggttcggggttacctttccgttttaatttaaccgaggtctaaggttgggttaacgtactaacttaccgttccgactaacggtacccgttcccgggtagggaacgggggaccctaactttacccgaaccccgtaattcccgtacccgaaagggtaacaaaccctaaaccgttaccgtaaaaacggaaacccctaccggttaccttttacgtttttaaaccttaaccaaaaaagttacggaaaacccacggtaccccgtttagggggaaacggtaccggacccggtaaagttacggaaacccggtacccggggttacccgtttaaggttaacgtttaaccggttcggtaggggaccggaaagggtacgggttaacgggtaccccgggggacccctaaaacgggtaaaccttttaaccggcgggttacttaacggggtacgggaacccgggttcgggaccggggggaaccctaaaaccgggggccccgttaacccggg

SEQ ID NO: 423166 - DNA, 568 bp, Homo sapiens
  misc_feature: GZ8MTXP01BF8OV.11.25.C03.1.454.CMB.2.raw
  modified_base (299)..(299): a, c, t, g, unknown or other
  modified_base (359)..(359): a, c, t, g, unknown or other
  modified_base (368)..(368): a, c, t, g, unknown or other
  modified_base (383)..(383): a, c, t, g, unknown or other
  modified_base (388)..(388): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagtgggtccncaggctccgaggggaggctggagtggtctcctttattacagcagtgtagtacatactcgnagctccggngcgggcatcacatcncaganacaactctaagacacgtcttgtttctacaaatgaacagccgtgggacgacgccgagtcggaccgacggtccgttagttaacttcgtggtgcgaaggtacgacggtcggggaccccaacggtaaccgttacttacgctaagtcggaaccgttcggcggggacccaagggcccgtaaccggg

SEQ ID NO: 423167 - DNA, 616 bp, Homo sapiens
  misc_feature: GZ8MTXP01CPV04.11.25.C03.1.454.CMB.2.raw
  modified_base (373)..(373): a, c, t, g, unknown or other
  modified_base (400)..(400): a, c, t, g, unknown or other
  modified_base (514)..(514): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtggaggtgcgtcgtggtggagtcgtggaggaggcctgactccagccggtcgggggtccctgacgactctctgtgcagcctcgtggttcaccgtcagtcacacctacatgagttcggtccgccgaggcctccgaggggaagggctggagttgggtcttcctttatttacagcagtggtagtacatatcgnagactccggtggcggggccattccacntctacagacgaacaactactaaagaaccacgctttcgtttacctacaaattcgaaacgagcccgtaggggacgacggccgaagtgaacccgacgggtccgttagtactttacgnggtcgacgaaggacgaggtccggggacccaaacggtaacttaccgcgttctaaggtcggtaacggtcggtcgggggacccgtaaacggggcccgtaaccggg

SEQ ID NO: 423168 - DNA, 747 bp, Homo sapiens
  misc_feature: GZ8MTXP01EX1AZ.11.25.C03.1.454.CMB.2.raw
  modified_base (297)..(297): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggccnccgaggcctccgaggggaggcgtggagtggtctctttatttacagctagtggtacgtactattacttccgactagacccgttcccgggtgggaacgggggtcccgtaatttcccaaccctattccgtacccaaaggaacgaaacctaaaccttaccgtaaaacgaaacccgtacgtaccttttacgtttttacctaacaaaaagtcggaaaacacgtcccgttaggggaacggtaacggacccgtaagtaccggaacccgtaccggggttcccgttaaggtttaacgttaccgtgggtacggcggaaagggtacggttaacggggtcccgggggaaccccctaaacgggttaaaacccggtttcccgttaaacggttccgtttaaaggtcggggtaacccggttcggtaccggggggaaccccgtaaacgggggttccccgtaacccggg

SEQ ID NO: 423169 - DNA, 629 bp, Homo sapiens
  misc_feature: GZ8MTXP01DOB6H.11.25.C03.1.454.CMB.2.raw
  modified_base (297)..(297): a, c, t, g, unknown or other
  modified_base (359)..(359): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtcgtggaggaggcctgatccagccgtgggggtccctgagactctcctgtgcagcctcgtgggttcaccgtcagtcacacctacatgagttgggccnccgaggctcgaggggaggctggagtggtctctttattacagcagtggtagtactatactcgnagacctccgtggcggggcctagttccaccatctaccagaacgacaaactactaaagaaccacggtactttagtttacttaacaaaatcgaaacagtacctaggggaacgacggcccgaagtacggaaccgtaaccgggtccgttaggtaactttaccgtggtacgcggaagaacggttcggtaccgggggacccctaaacggtaacgttaacgttcgaccttaagtcgggaaccgttcggacgggggaccctaacggggccctaaccggg

SEQ ID NO: 423170 - DNA, 587 bp, Homo sapiens
  misc_feature: GZ8MTXP01BIFB3.11.25.C03.1.454.CMB.2.raw
  modified_base (377)..(377): a, c, t, g, unknown or other
  modified_base (553)..(553): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggtccgccgaggcctaccggagggggaaggggctggggagttggggtcttcctttatttacagcagtggtagtacatatccgnagacctccggtggcggggccagttccaccatcctaccagacgacaactcaaagaacacgtcttagtttctacaaatcgaaacagcctagggacgagcccgagtcgaccgcggtccgtagttacttacgtgtgcggaagaggagtcggggacccaggtaacgttacgcgttctaagnggcgtcggcggggaccaacggggccctaaccggg

SEQ ID NO: 423171 - DNA, 706 bp, Homo sapiens
  misc_feature: GZ8MTXP01EXJVS.11.25.C03.1.454.CMB.2.raw
  modified_base (297)..(297): a, c, t, g, unknown or other
  modified_base (337)..(337): a, c, t, g, unknown or other
  modified_base (374)..(374): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggtcaccgtcagtcacacctacatgagttggtccncaggctccgaggggaggctggagtggtctctttatttacngcaggtggtagtacatacttccgcagaccgtcccggnggaacgggggcctagttcccaacctatccctaccaagacgaaccaaaccttactaaaaggaaacctacggtcttacgtttttacctaacaaaatcggaaactacggtcccttagggggaacgaacggtacccgaagtacggaacccgtaccggggtccgttacggttaaattaccgtggtacggcggaaaggaacgggttacgggtcccgggggacccccgtaaacgggttaaacccggtttaaccgttaaccggacgtttaacggtcggggtaacccgggtttccgggtacggggggacccgaaaacggggggttcccccgtaacccgggg

SEQ ID NO: 423172 - DNA, 590 bp, Homo sapiens
  misc_feature: GZ8MTXP01AOVYJ.11.25.C03.1.454.CMB.2.raw
  modified_base (284)..(284): a, c, t, g, unknown or other
  modified_base (297)..(297): a, c, t, g, unknown or other
  modified_base (362)..(362): a, c, t, g, unknown or other
  modified_base (376)..(376): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctanatgagttcggccncaggctcgaggggaggctggagtggtctctttattacagcagtgtatacatatcgcagactccgnggcgggctatcacntctcagacacaactcaaagaacacgtcttgtttactacaaatgaaacagtcctgggagacgccgatcgaaccgcgggtcctagttacttacgtggtcgcgtaaggacgacgggtccggggaccccaaacgggttaaaccgttacgttaccgcgttaaggcggggtaaccggttcgggacgggggaccccaaacgggggttccccgtaacccggg

SEQ ID NO: 423173 - DNA, 584 bp, Homo sapiens
  misc_feature: GZ8MTXP01DX3T1.11.25.C03.1.454.CMB.2.raw
  modified_base (299)..(299): a, c, t, g, unknown or other
  modified_base (341)..(341): a, c, t, g, unknown or other
  modified_base (363)..(363): a, c, t, g, unknown or other
  modified_base (544)..(544): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtgggggtccctgagactctcctgtgcagcctcgtgggttcaccgtcagtcacacctacatgagttcgggccnccaggctccgaggggagggctggagtgggtctctttattacngctagtggtatacatacttcgnagacgtccggtgaacgggggccagttccacctatcctaccaagacgaactaaactactaaacgaacacgtcttagtttacttacaaatagaacagcctagggacgagcccgagtcgaacgacggtccgtagtacttacgtgtcgcgaagcgaggtcgggacccgaacgtaacgttacacgntaagtggaacgtcggtcgggaccaacgggccgtaacccgg

SEQ ID NO: 423174 - DNA, 537 bp, Homo sapiens
  misc_feature: GZ8MTXP01DS2I7.11.25.C03.1.454.CMB.2.raw
  modified_base (371)..(371): a, c, t, g, unknown or other
  modified_base (512)..(512): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaacgcggccctcgagggactccctgacgccgattctctggcctaacccaactcgtaggggaaaccncacgcccactctcgacccatccgacggccgggacccaggctaagtggatgaggctagacttattattgtcgaggcgtgggacaggcagcactcgcccgttaatcgttcgttcggaacgtcgggaaccttaggttcaccgtntgcgtcacgcccaacgcccaacccc

SEQ ID NO: 423175 - DNA, 619 bp, Homo sapiens
  misc_feature: GZ8MTXP01CCUKT.11.25.C03.1.454.CMB.2.raw
  modified_base (345)..(345): a, c, t, g, unknown or other
  modified_base (365)..(365): a, c, t, g, unknown or other
  modified_base (377)..(377): a, c, t, g, unknown or other
  modified_base (391)..(391): a, c, t, g, unknown or other
  modified_base (413)..(413): a, c, t, g, unknown or other
  modified_base (439)..(439): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtgggggtccctgagactctcctgtgcagcctcgtgggttcaccgtcagtcacacctacatgagttcgggtccgccgaggctccgaggggaagggctgggagtgggtctctttattacngcagtgtagtacatactcgnagactccgtggngggcattcacatcncagacacaactactaagaaccncgtcttgtttactacaaatgaaaccncgaccgtagggacgacgccgagtacgaccgtccggtcgttagttacttcgtggtacgcggtaaggacggttacgggtacccggggaacccctaaacggttaaccgtttaaccgcggttacgtaagggtcgggtaaccggttcgggtaccgggggaacccgtaaccggggcccgtaaccgg

SEQ ID NO: 423176 - DNA, 557 bp, Homo sapiens
  misc_feature: GZ8MTXP01C5TKI.11.25.C03.1.454.CMB.2.raw
  modified_base (298)..(298): a, c, t, g, unknown or other
  modified_base (340)..(340): a, c, t, g, unknown or other
  modified_base (359)..(359): a, c, t, g, unknown or other
  modified_base (370)..(370): a, c, t, g, unknown or other
  modified_base (384)..(384): a, c, t, g, unknown or other
  modified_base (390)..(390): a, c, t, g, unknown or other
  modified_base (471)..(471): a, c, t, g, unknown or other
  modified_base (478)..(478): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctggttttcttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccnccaggctcgaggggagggctggagtggtctcctttatttacngcagtgtagtacatatcgnagactccgtgnggggcatcacatcncaaganaacaactactaaagaacacgcttgtttctacaaatgaaacagcctaggacgagccgatcgacacggcctagtacttactgngcgaagngagtcggggaccctaaacgaacgtttacgacgctaagtcgggaacgttcgacgggggaccaaacggggccctaaccggg

SEQ ID NO: 423177 - DNA, 546 bp, Homo sapiens
  misc_feature: GZ8MTXP01AZFRR.11.25.C03.1.454.CMB.2.raw
  modified_base (370)..(370): a, c, t, g, unknown or other
  modified_base (513)..(513): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggactcccgtgacgccgatttctcgtcggcctaacccaactcgtagggaaacncacgcccactctacgaccatcgacggccgggacccaggcctagtcggatgagtctagacttagttattgtcgagggcgtgggacagcagtcacgtgcccgttaatcgttcgtacggacgtcgggaccagggttccaccggttnttgcgtcgacgacccgaacggcccctaaccccg

SEQ ID NO: 423178 - DNA, 626 bp, Homo sapiens
  misc_feature: GZ8MTXP01EAB1X.11.25.C03.1.454.CMB.2.raw
  modified_base (370)..(370): a, c, t, g, unknown or other
  modified_base (379)..(379): a, c, t, g, unknown or other
  modified_base (394)..(394): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttcgggtcccgcgaggctccgaggggaagggctggagtgggtcttcctttatttacagcagtggtagtacatacttcgnagactccgngcggggcattccacntctcagacgaacaactactaaacgacacgtcttgtttactacaaatcgaaacagccctaggggaacgtacgacccgtaagtcggaaccgtaccggggtccgttaggtaactttacgtggtacgacggaaggaaggttacggccgggggttaaccccaaaggttaaacccggttacttacgcgttaagtcgggaacgttcggcggggaccgtaaacggggccctaacccgggg

SEQ ID NO: 423179 - DNA, 607 bp, Homo sapiens
  misc_feature: GZ8MTXP01EDARB.11.25.C03.1.454.CMB.2.raw
  modified_base (276)..(276): a, c, t, g, unknown or other
  modified_base (288)..(288): a, c, t, g, unknown or other
  modified_base (338)..(338): a, c, t, g, unknown or other
  modified_base (357)..(357): a, c, t, g, unknown or other
  modified_base (437)..(437): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtcgggggtccctgagactctcctgtgcagcctcgtggttcaccgtnagtcacacctanatgagttggccgcagctcgaggggaggctggagtggtcttctttattacngctagtgtatacatctcgnagactccggtggcggggcctacttcacctatcctcagacaacaactcaaacacacgtcttgttttacacaaatcgaaacncgtacctggggaagacggaccgtagtcggaaccgaccggtcgttagttaacttccgtggtacgcggaagacggttaggtccgggggacccaaacggtaacgtttaccgcggttacttaaggtcgggaaccgttcgggaccgggggacctaaacgggggccctaacccggg

SEQ ID NO: 423180 - DNA, 614 bp, Homo sapiens
  misc_feature: GZ8MTXP01CR8XA.11.25.C03.1.454.CMB.2.raw
  modified_base (364)..(364): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggccgccaggctccgaggggagggctggagtggtctctttatttacagcagtggtagtacactattccgnacgacctccgtggcggggcctattcaccatctaccagacacaaactctaaagaccacgtcttgtttactacaaatcgaaacacgcctagggagacgccgatcgaccaccggtcgtagtaacttacgtggtgcggtaaggaagacggtacccgggggcccctaaaacggtaaccgtttacgttaaccgccgttaaggtcgggtaaccgttccggtacgggggacctaaacgggggaacccctaacccgggg

SEQ ID NO: 423181 - DNA, 547 bp, Homo sapiens
  misc_feature: GZ8MTXP01BQFGX.11.25.C03.1.454.CMB.2.raw
  modified_base (375)..(375): a, c, t, g, unknown or other
  modified_base (391)..(391): a, c, t, g, unknown or other
  modified_base (396)..(396): a, c, t, g, unknown or other
  modified_base (465)..(465): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccgccaggctccgaggggaaggggctgggagtgggtctcctttatttacagcagtggtagtacatattcgcagactccgtgnggggccattcacatcncaganacaactctaagacacgctgtttctacaaatgaacagcctggagagccgatgacacggccgtgtattacngtgcgaagagagtcggggccctacggaacgttacgacgctaagtgggaaccgtcggtacggggccaacggggcctaaccggg

SEQ ID NO: 423182 - DNA, 597 bp, Homo sapiens
  misc_feature: GZ8MTXP01D2TVB.11.25.C03.1.454.CMB.2.raw
  modified_base (287)..(287): a, c, t, g, unknown or other
  modified_base (364)..(364): a, c, t, g, unknown or other
  modified_base (376)..(376): a, c, t, g, unknown or other
  modified_base (498)..(498): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtgggttcaccgtcagtcacacctanatgagttcgggccgccaggctcgaggggaggctggagtggtcttctttattacagctagtgtagtactatactcganagaccgtccggnggcgggggcctattccacctatcctacaagacgaacaaactacaaagaaccacgtcttgtttactacaaatcgaacagcctagggaacgacgccgagtcgaacgcggtcttagtacttacgngtgacgaagcgacggtcggggacccaaacggtaacgttacgttcgacgttaaggtgggaaccgttcggacgggggacctaacgggggccctaacccggg

SEQ ID NO: 423183 - DNA, 725 bp, Homo sapiens
  misc_feature: GZ8MTXP01BPGDQ.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggtccaccgtcagtcacacctacatgagttcgggcccgccgaggcctaccggagggggaacggggtcgtgggtaggttcgggttcctttaccttttaagtttaccgaggtccgtaggttaggtacgtactacgttacgttcccgagtaacggtacccgtcccgggtagggaacggggggtccctacgttacccaaccctacttcccgtacccgaaaggaaccgtaaacctaaaccttaacgtaaaacgaaaccgtaccggttacctttaggtttttaacccttaccgtaaaaattacggaaacctacggtacccgttaggggaacggacggacccgtagtacggaaccgcggtccgtagtacttacgtgtcgcgaagacgcggtcgggaccctaacgtaaccgttacgcgttactaagtcgggtcgtcggcggggaccgaacggggaaccctaaccggg

SEQ ID NO: 423184 - DNA, 593 bp, Homo sapiens
  misc_feature: GZ8MTXP01DLV9U.11.25.C03.1.454.CMB.2.raw
  modified_base (372)..(372): a, c, t, g, unknown or other
  modified_base (456)..(456): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctttggaattgaattgagagataatatacttgtgtatcaacagaagccaggccagtcccctgtattggtcatctatcaagatgtgaagcggccctcgagggatccctgacgcgtactttcctcgtggcctacccgaaaacttcgtcggggaaaccnccaagcccaactcctgacccatcgaggccggggacccaggctagtggatggaggctgacttattagttgtcgaggcgtgggacnggcagctacgtcgtcccgttagtcggtccgttacgggaaaccgttgggggaaaccctaaggggttcccttacccggttcgtttcggaacggttccgacggaccccgaaacgggtcccccttaaaccccggtaacccg

SEQ ID NO: 423185 - DNA, 621 bp, Homo sapiens
  misc_feature: GZ8MTXP01DNQYB.11.25.C03.1.454.CMB.2.raw
  modified_base (341)..(341): a, c, t, g, unknown or other
  modified_base (362)..(362): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggtccgccaggctccgaggggagggctggagtggtctctttattacngcagtggtagtacatactcgnagactccgtggcggggccattccaccatctacagacacaactactaaagaacacgtcttgtttacttacaaaattcgaaacacgcctaggggaacgacgcccgaagtcgaaccgaccgggtccgttagtaactttacgtggtcggacggaagacggacgtccgggggacccctaaacgggtaaccgtttaacgaccggttactaagtcgggtaaccggtccggtacgggggaccgtaaacgggggcccctaacccgggg

SEQ ID NO: 423186 - DNA, 636 bp, Homo sapiens
  misc_feature: GZ8MTXP01EKLDI.11.25.C03.1.454.CMB.2.raw
  modified_base (364)..(364): a, c, t, g, unknown or other
  modified_base (396)..(396): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtcgtggaggaggcctgatccagccgtgggggtccctgagactctcctgtgcagcctctgggttcaccgtcagtcacacctacatgagttggtccgcaggctccgaggggaggctggagtggtcttctttatttacagcagtggtagtactatacttccganacgactcccggtggcggggctatccaccatcncagacacaactactaagaacacgtcttgtttactacaaaatgaaacagcctagggaagtacgcccgaatacggaacccgaccgggtccgttagttaacttaccgtggtacgcggtaaggacggacgggtccgggggaccccctaaacggggtaaaccgtttaccgttacggttacgttaacgtcggggtaacggttcccgggtacgggggacccgaaacgggggaaccccgtaacccggg

SEQ ID NO: 423187 - DNA, 584 bp, Homo sapiens
  misc_feature: GZ8MTXP01CK03I.11.25.C03.1.454.CMB.2.raw
  modified_base (256)..(256): a, c, t, g, unknown or other
  modified_base (289)..(289): a, c, t, g, unknown or other
  modified_base (303)..(303): a, c, t, g, unknown or other
  modified_base (322)..(322): a, c, t, g, unknown or other
  modified_base (344)..(344): a, c, t, g, unknown or other
  modified_base (364)..(364): a, c, t, g, unknown or other
  modified_base (374)..(374): a, c, t, g, unknown or other
  modified_base (387)..(387): a, c, t, g, unknown or other
  modified_base (390)..(390): a, c, t, g, unknown or other
  modified_base (428)..(428): a, c, t, g, unknown or other
  modified_base (488)..(488): a, c, t, g, unknown or other
  modified_base (503)..(503): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgatccagccgtcgggggtccctgagactctcctgtncagcctcgtgggtccaccgtcagtcacacctanatgagttcgggccncgagctcgaggggaaggcnggagtggtcttctttatttacngctagtggatacactatcgnagactccggngcgggctatcacntcncagtacacaactctaaagaaccacgtcttgtttctaanaaatgaaaccagtcccgtagggacgacgtcccgatcggaacccacggtcgtattattacnggtcgacgaagaagngtaccggggcctaaacgtacgtttaacgcggttacttaaggcggtaacgcggtacggggaccctaaggggccctaaccggg

SEQ ID NO: 423188 - DNA, 610 bp, Homo sapiens
  misc_feature: GZ8MTXP01DLQC2.11.25.C03.1.454.CMB.2.raw
  modified_base (375)..(375): a, c, t, g, unknown or other
  modified_base (557)..(557): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagaataaatattacttgttggtatcaacagaagccaggccagtccctgtattgtcatctatcaagatgtagaagccggccctgagggactcccgtgacgtccgtattctcgtcggccctacccaactcgtacgggaaacncacgccactctacgaccatcgacggccgggacccaggctagtggatggagctagtaacttagtttagttggtaccgagggtccggtgggaccaggccagtccacgttcgtccccgtttaagtcgttcgttaccggggaacgttacggggaacccgttaaacgggttcccgttaacccggttntttacggaaccgttaccgaccggaccccgtaaacgggcccccctaaaaccccg

SEQ ID NO: 423189 - DNA, 650 bp, Homo sapiens
  misc_feature: GZ8MTXP01ACKYJ.11.25.C03.1.454.CMB.2.raw
  modified_base (258)..(258): a, c, t, g, unknown or other
  modified_base (296)..(296): a, c, t, g, unknown or other
  modified_base (357)..(357): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctntgggttcaccgtcagtcacacctacatgagttgggccncaggctccgaggggaggctggagtggtctctttattacagctagtgtagtacatactcganagactccggtgcgggggccattccacctatcctccaagacgaacaactctaaacgaacacgtcttgtttactacaaatcgaaacagccgtagggaacgacggacccgaagtacggaaccgaaccgggtcccgttagttaacgtttacgtggtaggcgggaaggacggttacgggtccgggggaccccctaaacgggttaaaccggttttaccgaaccggttccgttaagggtacggggtaaccggttcccgggtacggggggacccctaaaggggggaacccctaacccgggg

SEQ ID NO: 423190 - DNA, 601 bp, Homo sapiens
  misc_feature: GZ8MTXP01CB5K8.11.25.C03.1.454.CMB.2.raw
  modified_base (376)..(376): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctgggagtgggtcttctttatttacagcagtggtagtacatattcgcagactccgtgnggggccattcacatctccagacgacaactctaaagaacacgtcttagtttctacgaaatgaaacagcctaggggacgaacgccgatcgaaccgacgggcccgttagtacttacgtggtcgcggaaaggcgaggtcgggggacccctaaacggtaacgtttacgttcgccgttaagtcggggtaacgttcggacggggggaccctaaagggggccctaacccgggg

SEQ ID NO: 423191 - DNA, 679 bp, Homo sapiens
  misc_feature: GZ8MTXP01A7E30.11.25.C03.1.454.CMB.2.raw
  modified_base (303)..(303): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagtttggctgagcttgggttttccttgttgcttaattttaaaaggagtccagtgtgaggtgcgtctggtggagtcgtggaggaggcctgactccagccgtgggggtccctgagtactctcctgtgcagcctcgtgggtcaccgtcagtcacacctacatgagttcgggtccnccgaggcctccggagggggaacgggcgtgggaggttcgggttccttaccttttatttacagtctaggttaggtagtactattacttccgactacggtacctcccgggtagggaacggggcccgtacttacccaccgtactcctaccgaagaacgaaccaactacgtaaacgaaccacgttaccttacgttttacctaacgaaacttacgaaaccacggtccctaggggaaacggacgaccgagtacgaaccgacgggtacttagttaacttcgtggtcggcggaaggacggacggtccgggggaccctaaacggtaacgttaccgacgcgtaagtcgggaacgttcggacggggaccaacgggaacccgtaaccgg

SEQ ID NO: 423192 - DNA, 641 bp, Homo sapiens
  misc_feature: GZ8MTXP01DDNEV.11.25.C03.1.454.CMB.2.raw
  modified_base (348)..(348): a, c, t, g, unknown or other
  modified_base (370)..(370): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccgaggctccgagggggaaggggctgggagtgggtctcctttatttacngcagtggtagtacatattccgnacgactccggtggcgggggccattccaccatctccagacgacaactactaaagaacacgcttcgtttcttacaaaattcgaaacacgtccctaggggaacggacggacccgtaagtcggaaccgaccgggtcccgttaggttactttaaccgtggtcggacggtaaggacggttacggtccgggggaccctaaacggtaacgtttacgacgttcttaaggtgggtaaccggtcggtacgggggttaccaaacgggggcccgtaacccgggg

SEQ ID NO: 423193 - DNA, 635 bp, Homo sapiens
  misc_feature: GZ8MTXP01AIACU.11.25.C03.1.454.CMB.2.raw
  modified_base (269)..(269): a, c, t, g, unknown or other
  modified_base (281)..(281): a, c, t, g, unknown or other
  modified_base (285)..(285): a, c, t, g, unknown or other
  modified_base (293)..(293): a, c, t, g, unknown or other
  modified_base (311)..(311): a, c, t, g, unknown or other
  modified_base (317)..(317): a, c, t, g, unknown or other
  modified_base (339)..(339): a, c, t, g, unknown or other
  modified_base (522)..(522): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtggtttctgtgctatttaaagagtcagtgtgaggtgcgtgtggtggagtcgtgggaggaggcctgatccaggccgtggggggtccctgagactctctgtgcagcctcgtgggttcaccgtnagtcacacctangtgngtcggccncgagcgcggaggggaggngtaggngtcgttcttactttatacgagngtaggtagtatactacttaccgtcgacacgtccgtaccgggagggcgggcctactaccacctatccacgaagaacaactaactaacgaaacgactaccgttactttacgttactaacgaaagtacgaaccgacgtacgtaggggaacgacgacctagacgacgacggtcgttacgtattcggngtacggagaacgtaaggccgggtaccgggaaccctaaacggttaacgttacgccggttataacgggtacggtccggtaccggggacgggaacccgtaacggggccccgaacgg

SEQ ID NO: 423194 - DNA, 666 bp, Homo sapiens
  misc_feature: GZ8MTXP01AVRV8.11.25.C03.1.454.CMB.2.raw
  modified_base (386)..(386): a, c, t, g, unknown or other
  modified_base (496)..(496): a, c, t, g, unknown or other
  modified_base (610)..(610): a, c, t, g, unknown or other
tcagcgagagataccacgaccggtgctcgatttagtagtgtagatttgggtttggggagaggagcccagcactgggattccgaggtgtttccattcggtaatcagcactgaacacagaggactcaccatggagttttggctgagctgggttttccttgttgctattttaaaaggagtccagtgtgaggtgcgtctggtggagtctggaggaggcctgatccagccgtgggggtccctgagctctcctgtgcagcctcgtgggttcaccgtcacgtcacacctacatggaggttcgggtccgccgaggcctccggagggggaggggctggggagtcgggtccttcttttatttacgagcgtaggtggtagtactattaccttccganacggtaccgtccggtagggaaccgggggtccctaaattccgaaccctatccgtaccaagaacgaactaaactactaaagaacacgtctttgttacttacaaatcgaaacngcctaggaggacgccgtatacgaccgaccggtccgttgttaacttacgtggacgccggaaggaacggtacggttccgggggaacccccttaaggtaaacccggtttacaccggnttacggtgggaccgttcgggacggggacccgaacgggaaccccgttaacgggtccc

SEQ ID NO: 423195 - DNA, 772 bp, Homo sapiens
  misc_feature: GZ8MTXP01AVEP7.11.25.C03.1.454.CMB.2.raw
  modified_base (287)..(287): a, c, t, g, unknown or other
  modified_base (636)..(636): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgacgactctcctgtgcagcctcgtcgggttcaccgtcagtacacacctanatggaggttcgggcccgcgacggcctaccggagggggaacggggcgtggggtaggttcgggttcctttaccgttttaatttacgagtcgtaaggttcggtaagttaacattacgttccgactagtacccgtaccgggttagggaacgggggccctattaccaacccacttccaccgaaagaaccgtaacctaaacgtaaccgtaaaacggaaaccctacggttaccttttacgtttttaacctaaaccgtaaaaagttccgaaaaccgtacgggtaccccgtaagggggaaacggacggaccccgtaagttcccggaaaccgccgggtaccgttagtaacgtttaccgnggtacgaccgggaaggacggttacggtccgggggaacccctaaacgggtaaccgtttacgttacgccgttaaggtaccggggtaaccgtaccggggtccgggggaacccgaaacgggggttccccgtaacccgggg

SEQ ID NO: 423196 - DNA, 609 bp, Homo sapiens
  misc_feature: GZ8MTXP01EA8QS.11.25.C03.1.454.CMB.2.raw
  modified_base (300)..(300): a, c, t, g, unknown or other
  modified_base (341)..(341): a, c, t, g, unknown or other
  modified_base (356)..(356): a, c, t, g, unknown or other
  modified_base (360)..(360): a, c, t, g, unknown or other
  modified_base (427)..(427): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtcgtggtggagtcgtggaggaggcctgatccgagccgtgggggtccctgagactctcctgtgcagcctcgtgggtcaccgtcagtcacacctacatgagtcggccncaggctccgaggggaggcgtggagtggtcttctttattacngcagtgtatacactntcgnagactccggtgcgggcatccacatcacagacacaactacaaagaactcgtcttgtttactacaaatnaacagcctaggaagcgaccgtatcgaccgaccggtcgttagtacttacgtgtcggacggtaagacggacgggttccggggaaacccctaaacggtaaaccgttaacccgttgttaccgttaagggtcgggtaaccggttcggaacgggggttacccgaaacgggggaaccccgtaacccggg

SEQ ID NO: 423197 - DNA, 610 bp, Homo sapiens
  misc_feature: GZ8MTXP01BLLQ9.11.25.C03.1.454.CMB.2.raw
  modified_base (362)..(362): a, c, t, g, unknown or other
  modified_base (445)..(446): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggccgcaggctccgaggggagggctgggagtgggtctctttatttacagcagtggtagtacatatccgnagactccggtggaacggggcccattcaccatctaccagacgacaactctaaagaaccacgtcttgttttctacaaatgaaacnncaggagacgccgatacgaccgacgggtccgttagtacttacgtggtcggacggaagaggttacgggtccggggacccctaaacggtaaaccgttccgttacgttcgtaaggtcgggtaaccggtcgggtacgggggaccccgtaaacggggccccgtaaccggg

SEQ ID NO: 423198 - DNA, 618 bp, Homo sapiens
  misc_feature: GZ8MTXP01BB9C1.11.25.C03.1.454.CMB.2.raw
  modified_base (378)..(378): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtccctgagactctcctgtgcagcctcgtgggtcaccgtcagtccacacctacatgagttcgggtccgccaggcctccggagggggagggctggagttgggtcttcctttattacgagctagtggtatacattactccgnagacctccggtggcggggcctattcaccatctaccagacgacaactactaaagaacacgtcttgtttactacaaattgaacagcctagggaacgacgacccgagtcgaccgccggccgttagttattaccgtggtcgacggaagacggacggtcgggggacccctaaacgggtaacgtttacgcgacctaagtcgggtaacgtcgggtacgggggacccaacggggaacccctaaccggg

SEQ ID NO: 423199 - DNA, 612 bp, Homo sapiens
  misc_feature: GZ8MTXP01ANKQC.11.25.C03.1.454.CMB.2.raw
  modified_base (364)..(364): a, c, t, g, unknown or other
  modified_base (393)..(393): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttctgtgctatttaaaggagtcagtgtgaggtgcgtctggtggagtctggaggaggcctgatccagccgtgggggtccctgagactctcctgtgcagcctcgtgggttcaccgtcagtcacacctacatgaggttcgggccgccgaggcctccgagggggaacggggctgggagtgggtccttctttattacagctagtggtatacatactcgnagactcgtggcgggcattcactatcacanacgactaactcgaaacgaacacgtcttagtttactaacaaatcgaaaccacgcagggacgacgccgagtcgacgcggtacgttagtacttggtggtacggacggaaggacggacgggtacccgggaacccgtaaacggttaaccgttacgccggttacgttaagggtcgggtaaccggtcggggaccgggggaacccgtaacggggttcccgtaaccgg

SEQ ID NO: 423200 - DNA, 680 bp, Homo sapiens
  misc_feature: GZ8MTXP01CWLL8.11.25.C03.1.454.CMB.2.raw
  modified_base (284)..(284): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgatccagccgtgggggtccctgagactctctgtgcagcctcgtgggtcaccgtcagtcacacctanatgaggttcgggcccgccgaggcctaccggaagggggaacggggtcgtggggaggttcgggttccttccttttaatttacgagtcgaggttggtaagtactacttacttcgacgagtaccgtaccgggtgggaacggggccctaagttccaacctatcctacgaggaacaacaactacgtaaagaacctacgtctttacgtttactaacaaatcgaaaccagtcctaggggaacgacggacccgagtcgaaccgaccgggtccgttagttattacgtggtcgacggtaaggaacgttagggtcccggggaccctaaacggtaaccgttaccgacgacgttaaggtcgggtaaccggttcgggacgggggaacccgtaaacgggcccgtaacccggg

SEQ ID NO: 423201 - DNA, 557 bp, Homo sapiens
  misc_feature: GZ8MTXP01BWQGI.11.25.C03.1.454.CMB.2.raw
  modified_base (368)..(368): a, c, t, g, unknown or other
  modified_base (457)..(457): a, c, t, g, unknown or other
  modified_base (520)..(520): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaagccggccctcgagggactcccgtgagccgattctcgtggctacccaactcgtagggaaacncacgccactctacgaccatcgacggccgggacccagggactagtgggatggaggctagtacttattacgttgtacgagggcgtgggacngacagctactcgtcccgttaatcgttcgttaccggaacgtcgggaaccaacggttccaccgtnttgaacgttcacggacccaacgggcccctaaaccccg

SEQ ID NO: 423202 - DNA, 638 bp, Homo sapiens
  misc_feature: GZ8MTXP01BE7OF.11.25.C03.1.454.CMB.2.raw
  modified_base (494)..(494): a, c, t, g, unknown or other
  modified_base (558)..(558): a, c, t, g, unknown or other
  modified_base (592)..(592): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatagagttttggctgagctgggttttccttgttgctattttaaaaggagtccagtgtgaggtgcgtcgtggtggagtctggaggaggcctgatccgagccgtgggggtccctgagactctcctgtgcagcctcgtgggtcaccgtcagtcacactacatgagtggtccgccagctccgagtggaaggggctggagtcgggtcttacctttatttacgagcaggtggtaagtaccagttactccgactacgtaacctcccgggtggacggggaccctattacccaacctactcctaccgaagacgaacctaaactacgtaaagaaaccctacgtccttttagtttacctaacaaaagtacgtaaaccncgtacccggtaaggaacggacgacccgagttaccgaaccgtacggtccgtagttacttacgtgngaacgagagtacgcgggacccaagttaccgttanaccgtaatagtcggtacgtcggttacggggaaccgaagggaacccg

SEQ ID NO: 423203 - DNA, 660 bp, Homo sapiens
  misc_feature: GZ8MTXP01ENOKE.11.25.C03.1.454.CMB.2.raw
  modified_base (618)..(618): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgattgagagataaatatacttgttgtatcaacagaagcaggccagtcccctgtattggtcatctatcaagatgtgaagccggccctcgaggggactcccgtggacgtccgtatttccgtcgttcggcccttaaccccgaaacgttccggtacggggaaacccgccaacggacccctaactccttacggaacccctagtaccgacgggacccggggaaccccaaggggtacccttaaagttcgggaacgttgggacgggtaccgttaggtaaacctttaaggttttaagtttcggttaccggaaggggtccgggttagggggacctacggaccgtacggctaacgtcggtcccgttaagtcgttcggtacgttacgtcgggtaacgacgttcnccgtgtcgtaagtccacgacccgaaccggaaccctaaccccg

SEQ ID NO: 423204 - DNA, 575 bp, Homo sapiens
  misc_feature: GZ8MTXP01AO5BN.11.25.C03.1.454.CMB.2.raw
  modified_base (174)..(174): a, c, t, g, unknown or other
  modified_base (299)..(299): a, c, t, g, unknown or other
  modified_base (343)..(343): a, c, t, g, unknown or other
  modified_base (433)..(433): a, c, t, g, unknown or other
  modified_base (478)..(478): a, c, t, g, unknown or other
  modified_base (532)..(532): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggngtccagtgtgaggtgcgtctggtggagtctggaggaggcctgatccagccgtgggggactccctgagactctcctgtgcagcctcgtgggttcaccgtcagtcacacctacatgagttgggtccnccaggcctccgaggggaggggctggagtgggtctctttattacngcagtggtataccatatcgcagactcgtggagggccatcacatctacagagacaactcaaagaacacgtcttgtttctacaaatcgaacncgccgtagagacgaccgatcgaccacgggtccgttagtattacgngtggcgaggaggtacgttcgggggacccctaaggttaaccggttacaccgggtntaggtggaccggtcggttacgggggtaaccaaggggaaccccg

SEQ ID NO: 423205 - DNA, 629 bp, Homo sapiens
  misc_feature: GZ8MTXP01A56WX.11.25.C03.1.454.CMB.2.raw
  modified_base (285)..(285): a, c, t, g, unknown or other
  modified_base (297)..(297): a, c, t, g, unknown or other
  modified_base (359)..(359): a, c, t, g, unknown or other
  modified_base (521)..(521): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggtttcctgttgctatttaaaaggagtccagtgtgaggtgcgtctggtggagtctggaggaggcctgatccagccgtgggggtccctgacgactctcctgtgcacgcctcgtggtcaccgtcacgtcaccacctantgagttcggccncgagcacgaggggaggctggagtcggtctctttattacgagctagtggtatactatactcgngagaccgtcggtggaacggggcctattccacctatctaccgaagacgaactaactactaaagacctacgtcttacgtttactacaaatcgaaactcgtccgtaggggaacgcggacccgagtacgtaaaccgccgggtactttagtaattccggtagccggnggaaggacggttagggtcccggggacccctaaacgggtaacgttaaccgcgttactaaggtcggggtaaccgttcggggaccggggaccgaacggggaacccgtccgg

SEQ ID NO: 423206 - DNA, 575 bp, Homo sapiens
  misc_feature: GZ8MTXP01EVFN4.11.25.C03.1.454.CMB.2.raw
  modified_base (393)..(393): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtgggtctctttatttacagcagtggtagtacatacttcgcagactccgtgcggggccattcaccatcnccagagacaactctaaagaacacgcttgttttactacaaatcgaaacagcctagggaagacgccgatcgacgacggccgtagtattactgtgcgaagagagtcggggacccaacggtaacgttacgttacgcttaagtcgggaacgtcggtacgggggaccaacggggaacccgtaaccggg

SEQ ID NO: 423207 - DNA, 635 bp, Homo sapiens
  misc_feature: GZ8MTXP01A3FYW.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtcgtcccaggacagacagccagaactccctgctctggtaattgaattgagagtaataaatattacttgttgtatacaacagaacgccaggccacgtcccctgtagttggctatctatacaagatgtagaacggtccggccctacgacgggtactcccgtgacgccgtacttctcgtcggcctaaccaacgtcgtacgggaacgtccacgccctaactctacgaccagtaccgacggaccgggacccaggtacctagtggagtggacgtctagtaacgttagtttacgtttacggcgtacgggtacggtacgggacgtaggaccgacgtaccgtaccgtcgtcccggttaattcggttaccgttacgggaccgtacggggtaaccttagggttcccttacggttcgttacggaacgttcgaccggttacccgaaccggcccctaaaccccg

SEQ ID NO: 423208 - DNA, 587 bp, Homo sapiens
  misc_feature: GZ8MTXP01DI2V2.11.25.C03.1.454.CMB.2.raw
  modified_base (369)..(369): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtgggaggaggcctgatccagccgtggggggtccctgagactctcctgtgcagcctcgtgggttcaccgtcagtcacacctacatgagttcgggccgccaggctccgaggggagggctggagtggtcttctttatttacagcagtggtagtacatacttcgnagactccgtgcggggcattccacatcacagagacaactactaaagaacacgtcttgtttacttacaaatgaaacagcctaggaagacgccgatcgacgacggccgttagtattacgtgtgcggaagaggagtcgggggaccctaaggaaccttacgttacgccttaagtcgggaaccggttcggtcgggggaccctaacggggaacccgtaacccggg

SEQ ID NO: 423209 - DNA, 750 bp, Homo sapiens
  misc_feature: GZ8MTXP01CLXPP.11.25.C03.1.454.CMB.2.raw
  modified_base (298)..(298): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccgagccggtcgggggtccctgagacctctcctgtgcacgcctcgtcgggttcaccgtcacgtcaccacctacngtgtaggttcgggtccgccgaggcctccggaagggggaacggggcgtaggggtaggttcggggttcctttacccgttttaagtttaaccgaggtaccgtaaggttaggttaacgtaactaacgttacgttaccgacgtaacggtacccgttacccgggttggggaaccgggggtcccgtaacttacccgaacctactcccgtaccgaagtaacgaactaaacctacgtaaaacgacctacgtcttttacgtttacctaacgaaaattcgaaactcgaccctaggggaacggaccggtaccgaacgttacggaacccgtaccggggtccgttaaggttaactacgtggtacgacggaagtaaggcgggtacgggaacccctaaacggttaacgttacgcgacgttaagtacgggtcgtcgggacggggaccgtaaccgggaaccgtaacccgg

SEQ ID NO: 423210 - DNA, 573 bp, Homo sapiens
  misc_feature: GZ8MTXP01EPKBZ.11.25.C03.1.454.CMB.2.raw
  modified_base (291)..(291): a, c, t, g, unknown or other
  modified_base (351)..(351): a, c, t, g, unknown or other
  modified_base (378)..(378): a, c, t, g, unknown or other
  modified_base (383)..(383): a, c, t, g, unknown or other
  modified_base (472)..(472): a, c, t, g, unknown or other
  modified_base (516)..(516): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagtttggctgagctgggttttccttgttgctatttaaaggagtccagtgtgaggtgcgtctggtggagtctggaggaggcctgatccagccgtgggggtccctgagactctcctgtgcagcctctgggttcaccgtcagtcacactacatgagtggccncaggctcgaggggaaggctggagtggtctcctttatttacagcagtgtagtacatatcgnagactcgtgcggggccattccacatcncaganacaactactaaagaacacgtcttagtttactacaaaatcgaaacagcctagggacgagccggaatcgaccgacggccgtagtattacgnggtcgcgaagaggacgtcggggacccctaaggtaaaccgttacncggactaacgtcgggaacgtcggtacgggggacccaaacgggggaacccctaacggg

SEQ ID NO: 423211 - DNA, 583 bp, Homo sapiens
  misc_feature: GZ8MTXP01BUT44.11.25.C03.1.454.CMB.2.raw
  modified_base (282)..(282): a, c, t, g, unknown or other
  modified_base (294)..(294): a, c, t, g, unknown or other
  modified_base (345)..(345): a, c, t, g, unknown or other
  modified_base (349)..(349): a, c, t, g, unknown or other
  modified_base (358)..(358): a, c, t, g, unknown or other
  modified_base (360)..(360): a, c, t, g, unknown or other
  modified_base (378)..(378): a, c, t, g, unknown or other
  modified_base (412)..(412): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtcgtggtggagtctggaggaggcctgatccagccgtgggggtccctgagactctcctgtgcagcctctgggtcaccgtcagtcacacctanatgagttggccncgagctccgagggaggctggagtggtctctttattacagcagtgatacatntcgnagactccgngngggcatcacatctcaganacaactacaaagaacacgtcttagtttacctaanaaatacgaacacgctaggacgacgaccgagtacgacgacggtcgttagttactacgtgtcggaggaagacggttacggtaccgggacccgtaaacggtaaccgttaacgcgttacgtaaggtcgggtaacgtacgggacggggaacccgtaacgggttaacccgtaaccgg

SEQ ID NO: 423212 - DNA, 753 bp, Homo sapiens
  misc_feature: GZ8MTXP01BGMGJ.11.25.C03.1.454.CMB.2.raw
  modified_base (540)..(540): a, c, t, g, unknown or other
  modified_base (625)..(625): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccaggccgtcgggggtccctgagactctctgtgcacgtcctcgtgggtccaccgtcagtcacacctacatggagttcgggcccgcgaggcgtaccggagggggaacgggcgtggaggtggtacttcgtttacccttttaatttacgagtcgtaggttaggttaagtacctagttacgttcccgacgtaacggtaaccgttcccgggtggggaaccgggggtccctaattacccaaccgtactccctacccgaaagtaacgaaaccctaaactacgtaaaacgaaccctacggttctttagtttaccctaaaanaaacgtcgaaacgtacgtacggtaggaacggaccgaccggtaagtaccggaaccgtaccgggttacgttagttaaccgtttcggngggtacggaacgggtaaggaacgggtacgggttacccgggaaccctaaacggttaaaccgttcgacggtgttacgggtccgggtaccgggtcggggaacgggggtaaccccgttaacggggtaacccg

SEQ ID NO: 423213 - DNA, 615 bp, Homo sapiens
  misc_feature: GZ8MTXP01AOY99.11.25.C03.1.454.CMB.2.raw
  modified_base (527)..(527): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtgggggtccctgagactctcctgtgcagcctcgtgggttcaccgtcagtcacacctacatgaggttcgggtccgccgaggcgtccgaggggaaggggcgtgggaggtgggtcttcctttatttacagctagtggtagtacactattcgcacgacgtccggtggaacggggcctagttccaccatcctcaagacgaacaactactaaagaaccacgtcttgtttacttacaaagttcgaaacacgccgtggggaacgagccgagtcgaaccacggccgttagtattacctggtcgacgaaggnggacgtcggggaccccaaggtaacgtttaccgacgttcgttaagcgggtaacgttcgggacggggaccctaagggggccctaaccggg

SEQ ID NO: 423214 - DNA, 593 bp, Homo sapiens
  misc_feature: GZ8MTXP01EYI38.11.25.C03.1.454.CMB.2.raw
  modified_base (274)..(274): a, c, t, g, unknown or other
  modified_base (512)..(512): a, c, t, g, unknown or other
  modified_base (529)..(529): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtnagtcacacctacatgagttcgggccgccaggctccgaggggaagggctggagtgggtctcctttatttacagcagtggtatacatattccgcgagacctccgtggaagggggccagttccacctacttcgagacgaaccaacgaccaaagaacaacggtataatctagacaaatgaaacagtcagggagaagggaccgaaagacgacggcttagtttaccttgtggtagagtaaaggngggtggcgtggttccgntaagttgggttatttcggaattcgtcggtcgggggaccgaagggggaaccttaaaggttccggg

SEQ ID NO: 423215 - DNA, 625 bp, Homo sapiens
  misc_feature: GZ8MTXP01AHL7S.11.25.C03.1.454.CMB.2.raw
  modified_base (300)..(300): a, c, t, g, unknown or other
  modified_base (362)..(362): a, c, t, g, unknown or other
  modified_base (393)..(393): a, c, t, g, unknown or other
  modified_base (398)..(398): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggccncaggctccgaggggagggctggagtggtctctttatttacagcagtggtatacatactccgnacgactccggtggcggggccattcaccatcncaganacaaacgtctaaagacacgtacttgtttactacaaagtcgaaacacgtcccgtaggggacgaacggcccgaagtcgaaccgaccgggtccgttagtaacttcgtcggtgcggaagacggaggtacccgggggacccctaaaccggtaacgtttaccgttacgacgttaaggtcgggaaaccggttccggacggggggacccctaaagggggaacccctaacccgggg

SEQ ID NO: 423216 - DNA, 694 bp, Homo sapiens
  misc_feature: GZ8MTXP01A8F3Y.11.25.C03.1.454.CMB.2.raw
  modified_base (375)..(375): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtgggtcaccgtcagtcacacctacatgagttcgggtccgccgaggcctccgaggggaagggcgtggaggttgggtcttcctttattacagctagtgtagtactattactccgnacgacgtcccggtgaacgggggccagttccaccatcctaccagacgacaactactaaagaacacgtcttagtttacctacaaagtacgaaacagtcccgtaggggaacggaacgtacccgaagtacggaacccgtaccggggtacccgttaggtttaacttacccgtgggtacggccgggaaaggtaacggttacggttacccggggggacccctaaacgggttaaacccggtttaacccgttacggaccgttaacggtcggggtaacccggtcgggtaccgggggaaccccgaaacgggggaaccccgtaacccgggg

SEQ ID NO: 423217 - DNA, 628 bp, Homo sapiens
  misc_feature: GZ8MTXP01D6Q4N.11.25.C03.1.454.CMB.2.raw
  modified_base (379)..(379): a, c, t, g, unknown or other
  modified_base (388)..(388): a, c, t, g, unknown or other
  modified_base (409)..(409): a, c, t, g, unknown or other
  modified_base (429)..(429): a, c, t, g, unknown or other
  modified_base (573)..(573): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtcgtggtggagtcgtggaggaggcctgatccagccgtgggggtccctgagactctcctgtgcagcctcgtggttcaccgtcagtcacacctacagtgagttcgggcccgccaggctaccgagggggaacgggcgtgggagtgggttccttactttattacagcagtggtatacatactcgnagcctccgngcggggccattccactatccncaagacaacaactactaaanaaccacgtcttagttttacaacgaaaatcgaaacacgtccctaggggaacgacgacccgaagtcgaacccgccgggtccgttagttaacttaccgtgtcggacgaaggacgttacggtcggggacccctaaaggtaacgttacncggttactaaggtcgggaaccgttcggacgggggaccaacggggccctaaccggg

SEQ ID NO: 423218 - DNA, 629 bp, Homo sapiens
  misc_feature: GZ8MTXP01A25W7.11.25.C03.1.454.CMB.2.raw
  modified_base (260)..(260): a, c, t, g, unknown or other
  modified_base (362)..(362): a, c, t, g, unknown or other
  modified_base (371)..(371): a, c, t, g, unknown or other
  modified_base (395)..(395): a, c, t, g, unknown or other
  modified_base (437)..(437): a, c, t, g, unknown or other
  modified_base (442)..(442): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctntgggttcaccgtcagtcacacctacatgagttgggcccgcaggctccgaggggagggctggagtgggtctcctttatttacagcagtggtagtacatatcgnagactccgngcggggccattcaccatctcaganacaactctaaagaacacgcttgtttacttacaaatcgaaacncgacnggagacgccgagtcgaccgacggtccgtagttaacttcgtggtcgacggaaggacggttacgggtaccgggggaccccgtaaaccgggtaaccggtttaccgttaccggttcgttaacgggtcggggtaacccggttccggggtaccgggggaaccccgtaaaccgggggttaaccccgtaaccggg

SEQ ID NO: 423219 - DNA, 658 bp, Homo sapiens
  misc_feature: GZ8MTXP01CS2IP.11.25.C03.1.454.CMB.2.raw
  modified_base (176)..(176): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctcgatgagttgactcagccaccctnagtgtccgtcgtcccaggacagacagccagaactcccctgctctaggaattgaattgaagtagtaataaattattacgtttgttggtaatcaaacagaacgccaaggcccacgtccctagtacttggtactatctatacgaaagtagtaggtaggaacggtcccgggtacccctacggaacggggtactcccgtaggacgtcccgtatttccgtcgtcggtcccttaaccccgtaagttccggtacgggaaaccgcacgtccctaactctacgacctacgtacggacggaccggacccgagggtacttaggtggagtagaacggtctagtaactttagtttagtttacgggtcgacggggtcgtacggggacacggaccgaggtaccacgtcgtcccgttaatcgttcgttacggacgtacgggaccgttaaggttcttaccgttgtacgcgtcgacgacccgtaacgaaccccgtaacccg

SEQ ID NO: 423220 - DNA, 560 bp, Homo sapiens
  misc_feature: GZ8MTXP01A664Q.11.25.C03.1.454.CMB.2.raw
  modified_base (372)..(372): a, c, t, g, unknown or other
  modified_base (393)..(393): a, c, t, g, unknown or other
  modified_base (480)..(480): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtgggtctctttatttacagcagtgtagtacatattcgcaagctccggnggcggctatcacatcacaganacaactacaaagaacagtctatttacctaacaaagtacaacacgacgacggacgacgacgacgacgacgacgacgtagtatatgtgngaagagagtcgggaccgaaccgtaacgttaacgttacgacgtaagtaggaacgcggtcgggaccggaacggaacgaaccg

SEQ ID NO: 423221 - DNA, 635 bp, Homo sapiens
  misc_feature: GZ8MTXP01BJ580.11.25.C03.1.454.CMB.2.raw
  modified_base (368)..(368): a, c, t, g, unknown or other
  modified_base (398)..(398): a, c, t, g, unknown or other
  modified_base (403)..(403): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccgaggctccgaggggagggctgggagtgggtcttctttatttacagcagtggtagtacatatccgnacgactccggtgcggggccatccaccatcncaganacaactctaagaacacgtcttgtttactacaaatcgaaacagccctaggggagacgccgatacgaccgaccgggtccgtaggttaacttaccgtggtcgacggaaggtaacggacggttccgggggacccctaaacgggtaaaccggtttaccgttaccggttcttaagggtcggggtaaccggttccgggtacggggggaccccgaaacgggggaaccccgtaacccgggg

SEQ ID NO: 423222 - DNA, 738 bp, Homo sapiens
  misc_feature: GZ8MTXP01C5IUF.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcagcctctgggttcaccgtcagtcacacctacatgaggttcgggtccgccgaggctccgagggggaaggggcgtgggaggttggggttccttccgttttaatttaccgagtcgtaggttggtaagtactattacttccgcaacgtaccgtcccgggttgggaacggggggccctaaacgtttcccaaccctacttcctacccaaaggaacgtaaaccaaacttaccgtaaaacgaaacctacgtctttacgttttaccttaacaaaattcgaaaacacgtccccgttaggggaaacggtacggacccgtaagttacggaaccgtacccggggtccgttacgttaacgtttaccgtggtcggaccggaaggaggttacggtccgggggaacccctaaagggtaaacccggtttaccgttacggccttaaggtcgggtaaccgggttccggtacgggggacccctaaacgggggccccgtaaccccgggg

SEQ ID NO: 423223 - DNA, 567 bp, Homo sapiens
  misc_feature: GZ8MTXP01EPLYW.11.25.C03.1.454.CMB.2.raw
  modified_base (364)..(364): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaagggctggagtggtctcctttatttacagcagtggtagtacatattcgnagactccgtgcggggccatccaccatctccagacgacaactcaaagaacacgcttgtttctacaaatgaaacagccctagggagagccgatcgaacgcggccgtgtacttacgtgtcgcgaagagagtcggggacccaaggtaacgttacgacgctaagtgggaacgtcggtacggggacccaaacggggaaccctaaccggg

SEQ ID NO: 423224 - DNA, 567 bp, Homo sapiens
  misc_feature: GZ8MTXP01A4ZHM.11.25.C03.1.454.CMB.2.raw
  modified_base (363)..(363): a, c, t, g, unknown or other
  modified_base (535)..(535): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggatcccgtgagccgattctctggcctaccaactctggggaaaccncacgccactcgtacaccatacgacggccggaccaggactagtggagtaggacgtctagtacttagtttagttcggtcgagggtcggtacgggacgaggcgacgtcctacgtcgtcccgttaagtcggttacgttacgggaacgtcgggaaccgttacggttccttaccgttntgaacgtcgaccgaccgaacgcccctaacccg

SEQ ID NO: 423225 - DNA, 639 bp, Homo sapiens
  misc_feature: GZ8MTXP01BWZWL.11.25.C03.1.454.CMB.2.raw
  modified_base (176)..(176): a, c, t, g, unknown or other
  modified_base (288)..(288): a, c, t, g, unknown or other
  modified_base (302)..(302): a, c, t, g, unknown or other
  modified_base (319)..(319): a, c, t, g, unknown or other
  modified_base (458)..(458): a, c, t, g, unknown or other
  modified_base (521)..(521): a, c, t, g, unknown or other
tcagcgagagataccacgaccggtgctcgatttagtagtgtagatttggggtttggggagaggagcccagcactgggattccgaggtgtttccattcggtgatcagcactgaacacagaggactcaccatggagttttggctgagctgggttttccttgttgctattttaaaaggntccagtgtgaggtgcgtctggtggagtcgtggaggaggcctgactccgagccgtgggggtccctgagtactctcctgtgcagcctcgtgggtcaccgtcagtcaacacctanatgagttcgggccncgagctcgaggggaggntggagtggtcttctttatttacagctagtggtaatacacttctccgcagtaccgtccggaggcggggcctattccaccagtcaccgagtacgaactaactacaaagaacctcgtctttagtttactacaaatcgaaacncgtaccgtaggggaacgcgccgtaagtcgaaccgtacgggtccgttagtacttacgtggtcgnggaacggtagacgggttccgggggaccctaaacggtaacccgtttacgaccggacgttaaggttacgggaaccgttcgggtacgggggaacccctaagggggttaacccctaaccggg

SEQ ID NO: 423226 - DNA, 758 bp, Homo sapiens
  misc_feature: GZ8MTXP01CH7YN.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtcgtccccaggacagacagccagaactcccctgctctggaattgaatgagagataatattatgttgtatacaacagaagcaggcctacgtccctagtattggtcatctatacaagtagtgtaggaacggcccggtaccccgtacggacggggtacctccccggtaggacgtccccggtactttccgtcgtcgggcccttaaaccccgaaacgttccggaacggggaaacccgccgaacgtacccctaacgttccgtaccggaaccctacgtaccggaacgggaccccggggaaccccgtaaggggtaccttaaggtgggtaacgttagggaacgggtaccgttaggtaaaccttttaaggtttaacggtttacgggtaccggtaacgggggtccgggttaacggggaccgaacggacgtaccggtacccgttaaccggttccggttaccccggtttaagttccggtttaccggtttaaccgggaaccggttaccggggaacccgttaacgggttccgttaccgttcgttcggaacgtaccgaccgttacccgaaaccggccccctaaaccccg

SEQ ID NO: 423227 - DNA, 591 bp, Homo sapiens
  misc_feature: GZ8MTXP01DDSVR.11.25.C03.1.454.CMB.2.raw
  modified_base (300)..(300): a, c, t, g, unknown or other
  modified_base (340)..(340): a, c, t, g, unknown or other
  modified_base (342)..(342): a, c, t, g, unknown or other
  modified_base (361)..(361): a, c, t, g, unknown or other
  modified_base (391)..(391): a, c, t, g, unknown or other
  modified_base (396)..(396): a, c, t, g, unknown or other
  modified_base (412)..(412): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccncaggcctcgaggggaggctggagtgggtctctttattacngnagtgtagtacatattcganagactccggtgcgggggccattcaccatcncaganacaactctaaagaacncgcttagtttactacaaaatcgaaactgcctagggagaacgccgaatcgaaccgacggccgtagtattaccgtgtcgcgaagagaggtaccgggggaccctaaacgggtaacgtttacgacgccgttaagcgggtaaccggttcggacgggggaccctaagggggaaccccgtaacggg

SEQ ID NO: 423228 - DNA, 655 bp, Homo sapiens
  misc_feature: GZ8MTXP01B5M6R.11.25.C03.1.454.CMB.2.raw
  modified_base (339)..(339): a, c, t, g, unknown or other
  modified_base (358)..(358): a, c, t, g, unknown or other
  modified_base (369)..(369): a, c, t, g, unknown or other
  modified_base (382)..(382): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctatttaaaaggagtccagtgtgaggtgcgtctggtggagtctggaggaggcctgatccagccgtgggggtccctgagactctcctgtgcagcctcgtgggttcaccgtcagtcacacctacatggagtcgggtccgccaggcctcgaggggaagggctggagtggtctctttattacngcagtgtagtacatatcgnagactccgtgngggcatcacatcncagacacaactactaagaacacgtcttcgtttacttacgaaaattcgaaacacgacccgtggggaacgtacggccccgaagttcggaaacccgtaccggggtcccgttaggttaaactttacggtgttcgggaccggtaaggaacgggttacggttccggggggaaccccctaaacgggtaaaccgtttccgaacggttacctaaggttcgggggaaccgtttccggggtacggggggaaccccgtaaagggggttaacccccgtaaccgggg

SEQ ID NO: 423229 - DNA, 743 bp, Homo sapiens
  misc_feature: GZ8MTXP01E2V1K.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcacgtcacacctacatgaggttcgggtcccgccgaggccgtaccggaaggggggaacggggcgtaggggacggttcggggttcctttacccgttttaattttaaccgaggtcctaaggttgggttaaagttaacctaattaacttccggacaacggtaacccgtcccgggtacggggaacgggggtcccgtaaactttacccaaccctaacttcccgtacccgaaaggaacgaaacccaaaaccttacgtaaaacgaaaccacggttcttacgttttactaacgaaaattcgaaacagccctaggggacgaacggcccgtaagaccggaaccgcggtaccgttagttacttacgtggcgagaaggacgttacgggtaccggggaccctaaacggtaaccgttacgttacgttacttaaggtacgggtccggtcggggtacggggacccggtaaacggggcccgtaaccggg

SEQ ID NO: 423230 - DNA, 624 bp, Homo sapiens
  misc_feature: GZ8MTXP01BYFTB.11.25.C03.1.454.CMB.2.raw
  modified_base (290)..(290): a, c, t, g, unknown or other
  modified_base (300)..(300): a, c, t, g, unknown or other
  modified_base (343)..(343): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtcgtggtggagtcgtggaggaggcctgatccgagccgtgggggtccctgagactctcctgtgcagcctcgtgggtcaccgtcagtcacacctantgagtggccncgaggctcgaggggaggctggagtggtcttcctttattacagnagtgtatacatactcgcagactccgtaggcggggcctaacttccactatcctacagacgaacaactacaacgaaacacgtacttgtttactacaaagtacgaaacacgtacccgtagggaacggtacggacccgtaagtacggaacccgtacggggtacccgttagttaacttacgtaggtcggacggaagggacgttaggtccgggggacccaaacggtaaacgttaccgacgacttaaggcggtaacggtcggacggggaccgaacgggccgtaaccgg

SEQ ID NO: 423231 - DNA, 632 bp, Homo sapiens
  misc_feature: GZ8MTXP01EVK4S.11.25.C03.1.454.CMB.2.raw
  modified_base (327)..(327): a, c, t, g, unknown or other
  modified_base (370)..(370): a, c, t, g, unknown or other
  modified_base (381)..(381): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgactccagccgtggggggtccctgagactctcctgtgcagcctcgtgggttcaccgtcagtcacacctacatgagttgggcccgcgaggcctccgaggggagggctgggngtgggtcttctttattacagcagtggtagtacattacttcganagacctccggnggaacggggccattccaccattcctacagacgaacaactactaaagaacacgtactcgtttacttaactaaatacgaaactacgaccgtaggggacgacggacccgtagtacgaccgaccgggtccgttagttaacgttacgtggtcggcggaaggaacgttagggtccgggacccgtaaacccgggttaaccgttacgttacgtaacgtaggtcggtacggtcggttacgggtaaccggaacgggaaccg

SEQ ID NO: 423232 - DNA, 581 bp, Homo sapiens
  misc_feature: GZ8MTXP01CH1DR.11.25.C03.1.454.CMB.2.raw
  modified_base (259)..(259): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtgtatcaanagaagccaggccagtcccctgtattggtcatctatacaagatgtagaacgccggccctcgagggtactcccgtgacgcccgtatttctcgtcggcctaacccgaactcgtagggaaccgtcacgcccactctacgaccagtccgacggccgggaacccagggactagtaggatggacgctaggaacttagttagttcggtcgagggtcgtacgggacaggccagcctacgtcgtcccgttaagtcgttcgtacggacgtacgggaccaacggttccacgttcttagaacgtcgacgttacccgtaaccggccctaaaccccg

SEQ ID NO: 423233 - DNA, 602 bp, Homo sapiens
  misc_feature: GZ8MTXP01BR2IV.11.25.C03.1.454.CMB.2.raw
  modified_base (286)..(286): a, c, t, g, unknown or other
  modified_base (301)..(301): a, c, t, g, unknown or other
  modified_base (308)..(308): a, c, t, g, unknown or other
  modified_base (366)..(366): a, c, t, g, unknown or other
  modified_base (375)..(375): a, c, t, g, unknown or other
  modified_base (449)..(449): a, c, t, g, unknown or other
  modified_base (548)..(548): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctanatgagttcgggtccnccaggcnccgaggggagggctgggagtgggtctctttatttacagcagtggtagtacactatcgnagactccgnggcggggccattcaccatcctacagacgaacaactctaaagaaccacgtcttgttttactacaaattcgaaacngccctgggaacgaggcccgaagtcgaaccgaccggccgttagtacttacgtgtggcggtaagacggaggtccggggaccctaaaccgggaacgtttacncggttctaagtcgggaacgtcggtcgggggacctaacggggttcccgaaccggg

SEQ ID NO: 423234 - DNA, 563 bp, Homo sapiens
  misc_feature: GZ8MTXP01EY8ZN.11.25.C03.1.454.CMB.2.raw
  modified_base (337)..(337): a, c, t, g, unknown or other
  modified_base (355)..(355): a, c, t, g, unknown or other
  modified_base (383)..(383): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctggaggaggcctgatccagccgtgggggtccctgagactctcctgtgcagcctcgtgggttcaccgtcagtcacactacatgagttggccgcaggctccgaggggaggctggagtggtctctttatttacngcagtgtatacatatcgnagactccgtgaagggccattcaccatcncagacacaactcaaagacacgtcttgtttactacaaatgaacagcctgggagagccgatgacacggtctagtatctgtgcggaagagacgtcgggggacccctaagggaaaccgtttcgacgttccgttaagtcgggtaaccgtcggtcgggggaccctaacggggccccgtaaccgggg

SEQ ID NO: 423235 - DNA, 627 bp, Homo sapiens
  misc_feature: GZ8MTXP01BKE3C.11.25.C03.1.454.CMB.2.raw
  modified_base (360)..(360): a, c, t, g, unknown or other
  modified_base (410)..(410): a, c, t, g, unknown or other
  modified_base (414)..(414): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtccctgagactctcctgtgcagcctcgtggttccaccgtcagtcacacctacatggagttcgggtcccgccgaggcctccggagggggaagggcgtgggagttgggtccttctttatttacngctagtggtatacatactccgcagtcctcggtggcggggcctattcaccntccnccaagacgaacaaactactaaacgaaccacgtccttagtttactacaaatcgaaacagcctagggacgtacgaccgagtacgacccgcggtccgttaggttaacttacgtggtcgcgggtaagacggttacggtccggggaccctaaacggtaacgttaccgttacgcgtaagtggaacgtcggtcggggaccctaacgggcccgtaacccgg

SEQ ID NO: 423236 - DNA, 655 bp, Homo sapiens
  misc_feature: GZ8MTXP01BHYL3.11.25.C03.1.454.CMB.2.raw
  modified_base (353)..(353): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgaggccgtgggggtccctgacgactctctgtgcacgcctcgtgggtcaccgtcacgtcacacctacagtgagttcggccgcgaggctccggaggggagggctggagtggtcttcctttattacngctagtgtagtactatctcgcagtaccgtcggtaggcggggcctacttaccacctatcctcgaagaacgaacctaaactacgtaaacgaaacctacgttacgtttacgttttactaacgtaaaagtcgaaacacgtaccgtaggggaacgacggaccgtagtacgaccgaccggtccgttagtacgttcgtgtcggcgaaggacgacgggtccgggaccctaaacggtaacgttaccgttacggacgttaaggacggtaaccggtcgggcccccggggagaacccgggttccgtaacccggg

SEQ ID NO: 423237 - DNA, 553 bp, Homo sapiens
  misc_feature: GZ8MTXP01BNR82.11.25.C03.1.454.CMB.2.raw
  modified_base (287)..(287): a, c, t, g, unknown or other
  modified_base (301)..(301): a, c, t, g, unknown or other
  modified_base (361)..(361): a, c, t, g, unknown or other
  modified_base (481)..(481): a, c, t, g, unknown or other
  modified_base (488)..(488): a, c, t, g, unknown or other
  modified_base (517)..(517): a, c, t, g, unknown or other
  modified_base (522)..(522): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtgggggtccctgagactctcctgtgcagcctcgtgggttcaccgtcagtcacacctanatgagttcgggccncagctcgaggggaggctggagtgggtctctttatttacagtcagtgtagtacatatccgnacgactccggtggcgggggccattccacatctacagacacaactcaagaactcgtcttgtttctacaaatcgaacagcctagggacgacgccgatcgaccgtacggcgtagtctacgtgngcgaagngaggtcgggacccagtaacttacgaccgntaagnggcgtcgacggggaccaacgggaacctccgg

SEQ ID NO: 423238 - DNA, 582 bp, Homo sapiens
  misc_feature: GZ8MTXP01ASMP7.11.25.C03.1.454.CMB.2.raw
  modified_base (298)..(298): a, c, t, g, unknown or other
  modified_base (301)..(301): a, c, t, g, unknown or other
  modified_base (372)..(372): a, c, t, g, unknown or other
  modified_base (548)..(548): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagaataaatatacttgtggtatcaacagaagccagccagtccctgtattgtcatctatcaagntgngacgcggccctcgaggactccctgacgccgtattctcgtcggccttaacccaactcgtacggggaaacccncgacgccactcacgaccacgtacgacggacccgggaccaggtactagtaggagtacggacgtcgtagtacttagtttagttggtcgagggcggtacggacgacggcacgtccgtacgtccgtccgttaagtcggttacgtacggacgtacgggtaaccgttacggttcttaccgtntacggaacgtcgacgacccgaaccgcccaacccg

SEQ ID NO: 423239 - DNA, 590 bp, Homo sapiens
  misc_feature: GZ8MTXP01AQ6CH.11.25.C03.1.454.CMB.2.raw
  modified_base (364)..(364): a, c, t, g, unknown or other
  modified_base (509)..(509): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttgggtccgccaggctccgaggggagggctggagtgggtcttcctttatttacagcagtggtagtacatatcgnagactccgtgcggggccattcacatcctaccagacgactaactactaaagaaccacgtcttgttttcttacaaattagaaaccagaccctggggaacgtagcccgaagtcgacgaccggtccgttagtacttactgtggcgaagngagtcgggggccccaaaggtaaccgttacgacgccgtaagtcgggcgttcggcgggggacctaacggggcccgtaaccggg

SEQ ID NO: 423240 - DNA, 569 bp, Homo sapiens
  misc_feature: GZ8MTXP01EWS50.11.25.C03.1.454.CMB.2.raw
  modified_base (298)..(298): a, c, t, g, unknown or other
  modified_base (339)..(339): a, c, t, g, unknown or other
  modified_base (370)..(370): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtgtatcaacagaagccaggccagtcccctgtatggtcatctatcaagntgtgaagccggccctcgagggactcccgtgagccgatttcncgtggcctaaccgaactcgtacggggaaccncacgcctactctacgaccagtcgacggaccggaccgaggactagtaggagtggagtctagtacttagtttagttggtacgacgggtcggtacggacgaggacgacgtcctacgtccgtccgttaattcgttcgtacggacgtacggaacttacggttccttacgttctacgcgtcgacgacccgaaccgcccctaaccg

SEQ ID NO: 423241 - DNA, 680 bp, Homo sapiens
  misc_feature: GZ8MTXP01CFHMM.11.25.C03.1.454.CMB.2.raw
  modified_base (308)..(308): a, c, t, g, unknown or other
  modified_base (392)..(392): a, c, t, g, unknown or other
  modified_base (427)..(427): a, c, t, g, unknown or other
  modified_base (452)..(452): a, c, t, g, unknown or other
  modified_base (489)..(489): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtctgggaggaggcctgactccagccggtgggggtccctgacgactctctgtgcagcctcgtgggtccaccgtcagtcacacctacatgagttcgggcccnccgaggcctccggagggggaacgggctgggaggttcgggttccttaccttttattacgagctaggtggtatactatacttccgnacgacgtccggtgggcggggtcctaattccaaccntccacgaagacaacaactacgaaanaaccacgtcttacgtttactaaccgaaattcgaaacncgtacctagggaacgacgcccgaatcgaaccgcggtaccgttagtaacttaccgtggtcgcggtaaggacggttacggtccgggggaacccctaaagggtaaccgtttaaccgcggttaccgttaagggtcgggtaaccggttccggggtaccgggggaacccgtaaacgggggaaccccgtaacccgggg

SEQ ID NO: 423242 - DNA, 611 bp, Homo sapiens
  misc_feature: GZ8MTXP01AS1AS.11.25.C03.1.454.CMB.2.raw
  modified_base (301)..(301): a, c, t, g, unknown or other
  modified_base (319)..(319): a, c, t, g, unknown or other
  modified_base (341)..(341): a, c, t, g, unknown or other
  modified_base (516)..(516): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctggaggaggcctgactccagccgtgggggtccctgagactctcctgtgcagcctcgtgggttcaccgtcagtcacacctacatgagttggccncaggctcgaggggaggcnggagtggtctcctttatttacngcagtggtagtacacttatccgacagaccgtccggtggaacggggcccgattccaccgatcacccagacgaacaaacctcgtaaagaaccacgtccgttgttttacctacaaaattcgaaaccagccctaggggacgacggccgaagtcgacgaccggtccgttagtattaccgngtggcgaagacggacgtcgggggacccctaacggtaacgttaccgacgttcgtaagtgggaacgtcggtcgggggacctaacggggccaaccggg

SEQ ID NO: 423243 - DNA, 601 bp, Homo sapiens
  misc_feature: GZ8MTXP01AVLTY.11.25.C03.1.454.CMB.2.raw
  modified_base (270)..(270): a, c, t, g, unknown or other
  modified_base (365)..(365): a, c, t, g, unknown or other
  modified_base (377)..(377): a, c, t, g, unknown or other
  modified_base (398)..(398): a, c, t, g, unknown or other
  modified_base (405)..(405): a, c, t, g, unknown or other
  modified_base (411)..(411): a, c, t, g, unknown or other
  modified_base (438)..(438): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtcagtgtgaggtgcgtctggtggagtctggaggaggcctgatccagccgtgggggtccctgagactctctgtgcagcctctgggtcaccgtnagtcacactacatgagttggtccgcaggctaccgaggggaaggggctgggagtgggtccttcgtttattacagctagtggtatacattatccganagcctccgtggngggtccatcaccatcacaganacactanaacgancgtctgtttactaacaaattcgaaacncgtacgaggaacgacgtacgaagtccggaaccgtccggtacgttagttacttacgtgtacggacggaaggtacgaccgggtccgggaaccctaaacggtaacttcgttcgacgttaaggtcgggtaaccgttacggacggggaccgtaaccgggccctaacgg

SEQ ID NO: 423244 - DNA, 698 bp, Homo sapiens
  misc_feature: GZ8MTXP01EH0S8.11.25.C03.1.454.CMB.2.raw
  modified_base (501)..(501): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagtcttggggtttttccttgttgacttaattttaaaaggagtccagtgtgaggtgcgtcgtggtggagtcgtggaggagcctgatccgagccgtgggggtccctgagctctcctgtgcagtcctcgtcgggtccaccgtcagtccacacctacattggacggttcgggtcccgccgaggcgtaccggagggggaacgggtcgtgggaggttcgggttcctttacctttaagtttacgaggtcgtaggttacggtaacttactacgttaacttccgacgtacgtacccgtccgggtagggaacgggggtcctaacttccaacctacgtccctacgaaagtacaactaactacaaagaacncgtacttgtttacacaaagcgaacacgtcctagggaacgacgtaccgaagtcgaaccgtacgggtcgttaagttaccgttagtggtacgacggaaggtacgacgggtacccggggaacccaaacggttaaccgttacgttaccgttggtaagtcggaacgtcggggaccgggaaccgtaacgggcccgtaacccggg

SEQ ID NO: 423245 - DNA, 586 bp, Homo sapiens
  misc_feature: GZ8MTXP01CK3DM.11.25.C03.1.454.CMB.2.raw
  modified_base (341)..(341): a, c, t, g, unknown or other
  modified_base (361)..(361): a, c, t, g, unknown or other
  modified_base (386)..(386): a, c, t, g, unknown or other
  modified_base (389)..(389): a, c, t, g, unknown or other
  modified_base (408)..(408): a, c, t, g, unknown or other
  modified_base (433)..(433): a, c, t, g, unknown or other
  modified_base (540)..(540): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccagccgtgggggtcctgagactctcctgtgcagtcctcgtggtccaccgtcagtcacacctacatgagtcggccgccaggctccgaggggaggcgtggagtggtctctttattacngcagtgtagtacatactcgnacgacgtcgtggcgggctatcaccntcncagacacaatctaaagacncgtcttgtttacacaaatcgaaacngccgtaggaacgtacgccgaagtcggaaccgaccgggtccgttaggtaacttacgtggtcgacgaagtaagagtcggaccggaccctaaggttaaccgttcgacgtntacggtggtaacccggttcggacggggccgaaacggggtaaccccg

SEQ ID NO: 423246 - DNA, 521 bp, Homo sapiens
  misc_feature: GZ8MTXP01EF0E8.11.25.C03.1.454.CMB.2.raw
  modified_base (197)..(197): a, c, t, g, unknown or other
  modified_base (224)..(224): a, c, t, g, unknown or other
  modified_base (255)..(255): a, c, t, g, unknown or other
  modified_base (440)..(440): a, c, t, g, unknown or other
  modified_base (448)..(448): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctcctatgagttgactcagccaccctccatgtccgtgtcccccgganagacagccaccatcagctgctctgganatgtcttgactaatgagtatgcttctggtancagcagaaggcaggccagccccctgtcctactcatctttacaaaatccaggcgcctcgtgggtcctgagccgattcgtccggctccggaatctgggaacacagtcactctgaccatcagcggaccagctatgatgaggctgtctacttcgtgtcaggcgtgggacacgagcgtggtgtcggcggngggaaccngttcgtgccgtcttaaggcacgccccgaagggccttccggccccgtcggttcctaaccgttttcggtcccccg

SEQ ID NO: 423247 - DNA, 568 bp, Homo sapiens
  misc_feature: GZ8MTXP01E4TIC.11.25.C03.1.454.CMB.2.raw
  modified_base (376)..(376): a, c, t, g, unknown or other
  modified_base (437)..(437): a, c, t, g, unknown or other
  modified_base (459)..(459): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaaggggctggagtgggtctcctttatttacagcagtggtagtacactattcgcagactccgtgnggggccatcaccatctccagagacaactctaaagaacacgctgtttctacaaatcgaaacngcctggagagcccgatcgaacnccggtcctgtattacgtgtgcgaagagagtcgggggcccaaacggtaacgttacgttacgcctaatcgggaaccgtcgtacgggggaccaaacggggttcccaaccggg

SEQ ID NO: 423248 - DNA, 713 bp, Homo sapiens
  misc_feature: GZ8MTXP01B46YD.11.25.C03.1.454.CMB.2.raw
  modified_base (187)..(187): a, c, t, g, unknown or other
  modified_base (247)..(247): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttctgtgctatttaaaggagtcagtgtgaggtgcgtntgggtggagtctggaggaggcctgatccaggccggtgggggtcctgagactctctgtgcngcctcgttgggtcaccgtcacgtcacactacatggtagttcggcccgcgaggccgtacggagggggagggcgtgggtaggttcgggttacttccttttagttaccgagtactaggtaggtactactaagttacttcggacaacgccgttacgggagggcgggggtacctacttcccaaacctcttacccaacgaaagggaacaaacgtaaaccttaactaaacggaaaccctacggtcccttttatttaccttaaaccaaaaggttacaaacgtacgccttaaggggaacggacggtaccgaagttaccgaaccggtaccggtcgttaaggttacttaccgggtggtacggaggaacggtaggaccgggtaccgggaaccgtaaaccggttaacgttaccgacggttacgtaacggtcgggtaaccggtaccgggacggggaacccggtaaacgggcccgtaacgg

SEQ ID NO: 423249 - DNA, 574 bp, Homo sapiens
  misc_feature: GZ8MTXP01E424R.11.25.C03.1.454.CMB.2.raw
  modified_base (365)..(365): a, c, t, g, unknown or other
  modified_base (374)..(374): a, c, t, g, unknown or other
  modified_base (390)..(390): a, c, t, g, unknown or other
  modified_base (395)..(395): a, c, t, g, unknown or other
  modified_base (406)..(406): a, c, t, g, unknown or other
  modified_base (437)..(437): a, c, t, g, unknown or other
  modified_base (485)..(485): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctggaggaggcctgatccagccgtgggggtccctgagactctctgtgcagcctcgtgggttcaccgtcagtcacacctacatgagttcgggtccgccaggctcgaggggaagggctggagtgggtctcctttattacagcagtggtatacatactcgnagactccgngcggggcatcacatcncaganacaactcaaanaaccacgtcttgtttactacaaatcgaaacncgcctggggagacggcccgaatcgaaccgcggtccgtagttattacgngtgcgaagagcgtcggggacccaacggtaacttacgttacgcttaagcgggaaccgttcggcggggaccgtaaagggcccgtaaccggg

SEQ ID NO: 423250 - DNA, 695 bp, Homo sapiens
  misc_feature: GZ8MTXP01AQ4I7.11.25.C03.1.454.CMB.2.raw
  modified_base (300)..(300): a, c, t, g, unknown or other
  modified_base (384)..(384): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataatatacttgtggtatcaacagaacgcaggccagtccctgtattcggtcatctatacaagntgtgaagcggtccttacgaggactcccgtagagtcccgtatttctacgtcggaccttaacccaaacgttcgtagggggaaaccnccgacggccctaacgtctacgaccctaagttccgaacggggcccggggaaccccgagggtacccgttagtacggggtaactggggaacggtccgttaaggtaaccgtttagttttaagttcggtaccgtaagggggtccggtaggggaaccgaggactacgggaccctaacgttccggtacccggtttaatacggtttcccggttaaaccggaaccgttacgggggaaccccttaaggttcccgacccggtttaaccgttggaaccgttccccgaggttaccccctaaacgggaaccccccgtaaaccccg

SEQ ID NO: 423251 - DNA, 675 bp, Homo sapiens
  misc_feature: GZ8MTXP01EF15X.11.25.C03.1.454.CMB.2.raw
  modified_base (372)..(372): a, c, t, g, unknown or other
  modified_base (394)..(394): a, c, t, g, unknown or other
  modified_base (486)..(486): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgagccgtgggggtccctgacgactctactgtgcacgccgttgtcgggttccaccgtcacgtaccacacctacagtggacggttcgggcccgccgaggcctaccggagggggacgggctggagttgggtcttactttatttacngctagtgtagtacatactccgngagacctccggtggcggggaccagttccaacctatcctaccgaagaacgaactaaactactaaacgaacctacgtacttgttttacctaaanaaatacgaaacacgtacctaggggaacgacgaccgtaagtacgaaccgtccggtacgttagttaacgttcgtcggtacgcggaaggtaacggacgggtacccgggaaccccgtaaacggtaaccttacgcgttacgtaaggtacggtaaccggtcgggacgggacccgtaaccgggaacccgtaaccgg

SEQ ID NO: 423252 - DNA, 558 bp, Homo sapiens
  misc_feature: GZ8MTXP01A10IF.11.25.C03.1.454.CMB.2.raw
  modified_base (298)..(298): a, c, t, g, unknown or other
  modified_base (358)..(358): a, c, t, g, unknown or other
  modified_base (369)..(369): a, c, t, g, unknown or other
  modified_base (385)..(385): a, c, t, g, unknown or other
  modified_base (471)..(471): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccncaggctccgaggggagggctggagtgggtctctttattacagcagtgtagtacatatcgnagactccgtgnggggccattcacatcncagacgacaactactaagaacacgtcttgtttactacaaatgaacagcctgggagacgccgatgaccgacggccgtgtacttacgngtcgcgaagtagagtcgggggaccccaaggtaacttacgttcgctaagtgggaaccgttgcgggggaccaacggggcccgtaacggg

SEQ ID NO: 423253 - DNA, 672 bp, Homo sapiens
  misc_feature: GZ8MTXP01EIDYK.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgactccagccgtgggggtccctgagactctcctgtgcagcctcgtcggtcaccgtcacgtcacacctacatgacggttcgggtccgccgaggcctaccggaggggacgggcgtggagttcggtcttcctttatttacgagcgagtggtacgtacacttacttcgacacgtaccgtccggtaggcgggggtcctagttcccaacctactcctaccgaagacgaacctaaactactaaacgaacctacgtactttagttttaccaacgaaagtcgaaactacgtacccgtaggggaacgaccgaccgtaagtacggaacccgtaccgggtccgttaagttacttaccgtggtcggacggaaggaggttcggtaccggggacccctaaagggtaaccttacgacgacgtaagtcgggtaacgtcgggacggggaccctaacggggcccgtaacccggg

SEQ ID NO: 423254 - DNA, 633 bp, Homo sapiens
  misc_feature: GZ8MTXP01B7V0L.11.25.C03.1.454.CMB.2.raw
  modified_base (358)..(358): a, c, t, g, unknown or other
  modified_base (384)..(384): a, c, t, g, unknown or other
  modified_base (490)..(490): a, c, t, g, unknown or other
  modified_base (534)..(534): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggtcaccgtcagtcacaccctacatgaggttcgggtccgccgaggcctccggaagggggaaggggcgtgggagtggggttccttccgtttatttaccngcgagtggtagtacaattacttccgnacggacttcccgggtgggaacgggggccctaagttcccaccatctaccaagacgacaaactctaaagaaccacgtcttgtttctacaaatgaacagcctagggganacgggccagtacgaccaccgggtcttaggtacttacgtggtcgnggtaagaagaggtccggggaccctaaacggtaaccgtttacgaccgttcttaagcggggtaacgttcggcgggggaccctaacgggggccctaaccggg

SEQ ID NO: 423255 - DNA, 644 bp, Homo sapiens
  misc_feature: GZ8MTXP01BKFDJ.11.25.C03.1.454.CMB.2.raw
  modified_base (536)..(536): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtggtcaccgtcagtcacacctacatgaggttcgggtccgccgaggctccgagggggaaggggctgggagttggggtccttaccgtttatttaccagctaggtggtaagtactactacttccgcacgtaccgtccggttgggaacgggggtcccgaattccaccctactcctaccgaagacgaacctaactactaaacgaactacggtcttgtttacttaacgaaatcgaacagcctgggaagacgccgatacgaccgtacggtccgttagtattacnggtgcggaagacgaggtccggggaccctaacggtaacgttaccgttcggccgttaagtcgggtccgtccgggtacgggggaccctaagggggaaccccgtaacccggg

SEQ ID NO: 423256 - DNA, 586 bp, Homo sapiens
  misc_feature: GZ8MTXP01ER7DJ.11.25.C03.1.454.CMB.2.raw
  modified_base (193)..(193): a, c, t, g, unknown or other
  modified_base (251)..(252): a, c, t, g, unknown or other
  modified_base (269)..(269): a, c, t, g, unknown or other
  modified_base (275)..(275): a, c, t, g, unknown or other
  modified_base (279)..(279): a, c, t, g, unknown or other
  modified_base (290)..(290): a, c, t, g, unknown or other
  modified_base (296)..(296): a, c, t, g, unknown or other
  modified_base (306)..(306): a, c, t, g, unknown or other
  modified_base (308)..(308): a, c, t, g, unknown or other
  modified_base (310)..(310): a, c, t, g, unknown or other
  modified_base (323)..(323): a, c, t, g, unknown or other
  modified_base (325)..(326): a, c, t, g, unknown or other
  modified_base (342)..(342): a, c, t, g, unknown or other
  modified_base (427)..(427): a, c, t, g, unknown or other
  modified_base (486)..(486): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtggtttcgtgttaggctatttaaaaggagtcagtgtgagtgcgtntggtgagtctggaggagcctgatccgagccgtgggggtccctgagtactctctgtgcnncctcgtagggtcacgtnatcacnctangtgagtcggcncgagcnggagggaggngngngtgtctcttatangnngtgtagtatactatcncgacgacgtacgtcggcggcgtactacacactacacacgacactaactactaacgtaacgtacgtacttacttactaactaatanaacgacgacgaggacgacgacgacgacgacgtacgtacgtacgtacgttacgtagtcgngaaggacggttacggtacggaccgtaaacgtaacgttacgttacgttacgtaacgtacggtaacggtacggtacgggaccggtaaccggaaccgtaaccg

SEQ ID NO: 423257 - DNA, 818 bp, Homo sapiens
  misc_feature: GZ8MTXP01D4UGP.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtcttgggttttccttgttgcttaattttaaaaggagtccagtgtgaggtgcgtcgtggtggagtcgtggaggaggcctgactccgaggccgtgggggtccctgacgactctcctgtgcagcctcgtggtccaccgtcagtcacacctacagtggtaggttcgggcccgccgagggccctaccgggaaaggggggaacggggtcgtaggggtacggttcggggttcctttacccgtttttaagttttaaccgaggtcgtaaggttaggtaacgtaacctaagttaccgttccgacgaacggtacccgttacccgggtagggaaccggggggaccctaaacgtttacccaacccgtaacgtacccgtacccgaaaggtaaaccgtaaaccctaaaaccttacgtaaaaacggaaaccctaaccggttcttttacgttttacctaaaccaaaagttacgaaactacgtcccgtaaggggaacggtaacgaccccggtaagtaccggaaccgtaccggtaccgttaagttaacttaccggtgtacggacggaaaggtaacggacgggtcccgggggaaacccctaaacggtaaaccgttaccgttacggttaccgttaaggtcgggtaaccggttcgggtacgggggaaccccgtaaacggggccccgtaacccggg

SEQ ID NO: 423258 - DNA, 581 bp, Homo sapiens
  misc_feature: GZ8MTXP01B7ES1.11.25.C03.1.454.CMB.2.raw
  modified_base (378)..(378): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagcaggccagtcccctgtattggtcatctatcaagatgtagaagccggccctcgagggactccccgtgacgcccgtatttctcgtggcctacccaaacttcgtaggggaaaccnctacgcccactctacgaccatcaggccgggacccaggctagtggactgaggctagacttagttatcggtcaggcgtgggacagcagcacgtcgcccgttaatcgttcgttacggaacgttcggggaaccttaacgggttccttaacccggttcgttacggtaacgtaccgaccggaccccgtaaacgggcccctaaacccccg

SEQ ID NO: 423259 - DNA, 707 bp, Homo sapiens
  misc_feature: GZ8MTXP01A9VGL.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctctgggttcaccgtcagtcacacctacatgagttcgggccgccgaggcctccggaggggaagggctgggaggttgggtcttaccttttatttacgagacgtagtggtaagtactacttacttccgacacgtaccgtcccgggtgggaacgggggcccgtatttcccaacccgtactcctacccgagaacgaacaaacctacgtaaagaaacctaacgtctttacgttttaccttaacgaaattacgaaaaccagtaccccgtaggggaagaccggcccgaagtaccgaaccgacccggggtcttacgttaattaccgttggacggcggaaggtacggacggttccgggggaccccaaaacgggtaacccgtttacgttccggttacctaagggtcgggtaaccggttcgggaccgggggacccaaacgggggttccccgtaacccggg

SEQ ID NO: 423260 - DNA, 639 bp, Homo sapiens
  misc_feature: GZ8MTXP01CY3M4.11.25.C03.1.454.CMB.2.raw
  modified_base (299)..(299): a, c, t, g, unknown or other
  modified_base (374)..(374): a, c, t, g, unknown or other
  modified_base (481)..(481): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccnccgaggctccgaggggaagggctggagtggtcttccgtttatttacagcaggtggtagtactaacttacttccgnacgaccgtcccggtggcgggggccatttaccgacctatcctaccaagacgaacaaacctactaaacgaacctacggactttagttttcctaacgaaattacgaaacncgcccttagggacgacgccgaagtgaccgacgggtccgttagtattactgtgcgaagcgaggtcggggaccctaaacggtaacgttaaccgttcgaccgttaaggtcgggtaaccgttcgggacgggggaaccctaaacgggggcccctaacccgggg

SEQ ID NO: 423261 - DNA, 562 bp, Homo sapiens
  misc_feature: GZ8MTXP01BEHCE.11.25.C03.1.454.CMB.2.raw
  modified_base (374)..(374): a, c, t, g, unknown or other
  modified_base (490)..(490): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggtcaccgtcagtcacacctacatgagttgggtccgccaggctccgaggggaaggggctggagtgggtctctttatttacagcagtggtagtacatatcgcagacctccgtgnggggccgattcaccatctcagagacaactctaagaacacgcttgtttacttacaaattgaacagacctgggacgagcccgatgaccacggccgttgtattacctgtgcggaagagngtcgggggacccacgtaacgttacgttacgcctaatgggaacgtcggtggggaccgaacgggccgtaaccgg

SEQ ID NO: 423262 - DNA, 631 bp, Homo sapiens
  misc_feature: GZ8MTXP01AC4D2.11.25.C03.1.454.CMB.2.raw
  modified_base (370)..(370): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcccgatccagccgtggggggtccctgagactctcctgtgcacgcctcgtgggttcaccgtcagtcacaccacatgagttcgggtccgcaggcctccgaggggaggggctgggagtggtcttctttattacagcaggtgtagtacataccttccgnacgtacctccggtagggacgggggtcccacttccgaccctacgtcctaccgaaggtacgaaccaaacgtacgtaaaacgaacctacggtcttacgttttacttaacaaatacgaaacacgcctaggaacgtacggccgatcgacgtacggtctagtattacgtgtagcgagaagaggttccgggggacccaacggtaacgttacacgttccgttagtcggtacgtcgggtacggggaccgaacggggcccgcggtaacccg

SEQ ID NO: 423263 - DNA, 673 bp, Homo sapiens
  misc_feature: GZ8MTXP01CHYQL.11.25.C03.1.454.CMB.2.raw
  modified_base (304)..(304): a, c, t, g, unknown or other
  modified_base (412)..(412): a, c, t, g, unknown or other
  modified_base (449)..(449): a, c, t, g, unknown or other
  modified_base (459)..(459): a, c, t, g, unknown or other
  modified_base (485)..(485): a, c, t, g, unknown or other
  modified_base (531)..(531): a, c, t, g, unknown or other
  modified_base (538)..(538): a, c, t, g, unknown or other
  modified_base (546)..(546): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggtcaccgtcagtcacacctacatgagttcgggtcccnccgaggcctccgaagggggaaggggcgtggggaggttcggggttcctttaccttttaatttacagtcgaggttggtaagtactattacttccgcagaccgtcccgggnggcggggcctattccaccatccacagacaacaactanaaacgaaccncgtcttgtttactacaaatcgaaacngcctagggagacgccgatcggaaccgcggccgttagtactttacgnggtacgngtaacggnggttacgggtccggggaaccccctaaacgggttaaacccgtttaaccgaccggttcgttaaggtccggggtaacccggttccggggacggggggaacccctaaacgggggttaacccctaacccggg

SEQ ID NO: 423264 - DNA, 578 bp, Homo sapiens
  misc_feature: GZ8MTXP01DBZMT.11.25.C03.1.454.CMB.2.raw
  modified_base (371)..(371): a, c, t, g, unknown or other
  modified_base (425)..(425): a, c, t, g, unknown or other
  modified_base (534)..(534): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtggaggaggcctgatccagccgtgggggtccctgagactctcctgtgcagcctcgtggttcaccgtcagtcacacctacatgagttgggtccgccaggctaccgaggggaaggggctgggagtgggtctcctttattttacagcagtggtagtacatatcgnagactccgtgcggggcgattcaccatctcagacgacaactactaaagaacacgnttgtttctacaaatcgaacagccctaggacgagaccgatcgaaccgcggccgttagtaattactgtgcgaagagagtcggggcccaacgtaacgttacgttcgctaagngggtaaccgtcggtgggggaccctaacggggcccgtaacccggg

SEQ ID NO: 423265 - DNA, 633 bp, Homo sapiens
  misc_feature: GZ8MTXP01DTZ4R.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacactacatgagttcggccgccaggctccgaggggaggctgggagttggtcttcctttatttacagctagtggtatacatactcgcagacctccggtggcgggggcctacttccaacctatctaccgaaggacaacctaactactaaagaccacgtctttgtttactacaaatcgaaactagcccgtagggaacgacgaccgaatacggacgaccggtccgtaagttaacttccgtggtcggacggaagtacgttagggtcccggggaccctaaacggtaaccgttacgacgttacgtaacggtggaacccggttcgggacgggggaacccgtaaccggggaacccgtaaccccggg

SEQ ID NO: 423266 - DNA, 635 bp, Homo sapiens
  misc_feature: GZ8MTXP01DWJLS.11.25.C03.1.454.CMB.2.raw
  modified_base (276)..(276): a, c, t, g, unknown or other
  modified_base (289)..(289): a, c, t, g, unknown or other
  modified_base (303)..(303): a, c, t, g, unknown or other
  modified_base (344)..(344): a, c, t, g, unknown or other
  modified_base (346)..(346): a, c, t, g, unknown or other
  modified_base (375)..(375): a, c, t, g, unknown or other
  modified_base (524)..(524): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtcgtggtggagtcgtggaggaggcctgatccagccgtgggggtccctgagactctcctgtgcagcctcgtgggtcaccgtnagtcacacctacngtgagttcgggccncgaggctcgaggggaggcgtggagtggtcttctttattacngnagtgtatacatactcgcagaccgtccggnggcggggcctacttccacctatccaccaagacgaaactaactacgtaaagaacctacgtctttgtttactaacaaatcgaacacgacctaggggaacgacgtaccgaagtccgaaccgaccggtccgttaagttacttacgtggtcggnggtaaaggacggttacgggtccggggaacccctaaaggtaaccgtttacgttacgttaccgtaaggtacgggaacgtcggtacgggggaccgtaacgggcccgtaaccggg

SEQ ID NO: 423267 - DNA, 607 bp, Homo sapiens
  misc_feature: GZ8MTXP01ACWAS.11.25.C03.1.454.CMB.2.raw
  modified_base (300)..(300): a, c, t, g, unknown or other
  modified_base (460)..(460): a, c, t, g, unknown or other
  modified_base (509)..(509): a, c, t, g, unknown or other
  modified_base (524)..(524): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggccncaggctccggaggggagggctggagtggtcttctttatttacagcagtggtagtacatactcgcacgactccggtgggcggggccattccaccgtatctaccgaagacgaacaactacgtaaacgaaccacgtcttgttttacctacgaaaatcgaaacncgcctaggggacgacgccgatacggacaccgggtccgttagtacttcgngtcgcgaaggacggngtccgggggacccctaacggtaaccgttacgacggctaagtacgggaacgtcgggtacggggaccaacggggcccgtaaccgg

SEQ ID NO: 423268 - DNA, 820 bp, Homo sapiens
  misc_feature: GZ8MTXP01CY6VI.11.25.C03.1.454.CMB.2.raw
tcagcgagagataccacgaccggtgctcgatttagtagtgtagatttggggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccaggccgtgggggtccctgacgactctcctgtgcagcctcgtcggttcaccgtcagtcacactacatgagttcggccgccgaggcctaccggaggggaacggggcgtgggaggttcgggtccttccgttttatttacaggtcgtaggtagggttactacgtacttacgttccgagaacggtacccgtcccgggtagggaaccggggggtccctaactttaccaccctatccctacgaaagaacgaaacctaacctacgtaaacgaacctacggtactttacggttttacctaacaaaacgttaggaaacctacgggtcccttaagggggaacggtaacccgtacccgggaacgttaccggaaacccggtacccgggttaccgtttaacgggttaactttaaccgggtggttaacgggccgggtaaaagggcgggttaaaccgggggttccccgggggaaaccccgtaaaaaccgggttaacccgtttaaacccgacgggttaccggtaaacggttcccgggggtaaccggtttcccggggaaccggggggaaaccccgtaaaccgggggttaacccccggtaaccccgggg

SEQ ID NO: 423269 - DNA, 588 bp, Homo sapiens
  misc_feature: GZ8MTXP01B1QD0.11.25.C03.1.454.CMB.2.raw
  modified_base (305)..(305): a, c, t, g, unknown or other
  modified_base (344)..(344): a, c, t, g, unknown or other
  modified_base (367)..(367): a, c, t, g, unknown or other
  modified_base (378)..(378): a, c, t, g, unknown or other
  modified_base (396)..(396): a, c, t, g, unknown or other
  modified_base (537)..(537): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtctggaggaggcctgatccgagccggtgggggtccctgacgactctcctgtgcacgcctcgtcgggtcaccgtcagtcacacctacatgagttcggccncaggctcgaggggaggctggagtggtcttctttattacngtcgagtggtatacatacttcgnacgctccgggngcgggccattcaccatcncagacgacaacgtcaaagaacctcgtactttgtttacctacaaaagtcgaaacagccctaggggacgtacgccgagtcgacgcggtccgtagttatcgtgagcgaagcgagtcggggacccaaacgggtaactttcgaacncgttaagacgggtaaccgtcgggtcggggaccgaaaggggccctaaccggg

SEQ ID NO: 423270 - DNA, 678 bp, Homo sapiens
  misc_feature: GZ8MTXP01DT6H3.11.25.C03.1.454.CMB.2.raw
  modified_base (295)..(295): a, c, t, g, unknown or other
  modified_base (393)..(393): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgagccgtggggggtccctgagactctctgtgcagcctcgtgggtccaccgtcagtcacacctanatgaggttcgggccgcgaggctaccggagggggaacgggctgggtaggtcgggttcctttcctttatttacagtcagtggtatactactacttccganacgacgtcccggtaggcgggggcctattcccaaccatctaccaagacgaactaactactaaacgaacctacgtctttcgtttactaacaaatcgaaacacgtccgtagggaacgacgtaccgagtacggaaccgtaccgggtccgttaagttattaaccgtggtacggcgaaagggcgttacggtaccgggggacccctaaacggtaacgttaaccgttacggacttaaggtcgggtaaccggttcgggacgggggttacccaaaacgggggccctaacccgggg

SEQ ID NO: 423271 - DNA, 570 bp, Homo sapiens
  misc_feature: GZ8MTXP01AJ7PD.11.25.C03.1.454.CMB.2.raw
  modified_base (288)..(288): a, c, t, g, unknown or other
  modified_base (301)..(301): a, c, t, g, unknown or other
  modified_base (339)..(339): a, c, t, g, unknown or other
  modified_base (357)..(357): a, c, t, g, unknown or other
  modified_base (366)..(366): a, c, t, g, unknown or other
  modified_base (381)..(381): a, c, t, g, unknown or other
  modified_base (517)..(517): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccgagccgtgggggtccctgagactctcctgtgcagcctcgtgggttcaccgtcagtcacacctanatgagtcggtccncaggctcgaggggaggctggagtggtctctttattacngcagtgtatacatatcgnagactccgngcgggcatcacatcncagacacaactcaacgacacgtcttgtttctacaaatcgaaacagcctagggaacgacgccgatcgaacgtccggtccgttagtacttactggtgcggaagacggacggtccggggacccaaacggtaacgttacncggttctaagtcggaaccgttcgcgggggaccctaacggggcccgtaaccggg

SEQ ID NO: 423272 - DNA, 739 bp, Homo sapiens
  misc_feature: GZ8MTXP01BJ5S7.11.25.C03.1.454.CMB.2.raw
  modified_base (273)..(273): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggtcaccgtnagtcacacctacatgagttcgggtccgccgaggcctaccggagggggaaggggctgggaggttcgggttccttccttttatttacgagtcgaggttggtaagtactacttacttccgacacgtacccgtcccgggtagggaacggggggccctaacgtttcccaaccctacgttccctaccgaaagaacgaaacctaaacctacgtaaaacggaaacctaccggtactttacggtttttacctaaactaaaacgttacggaaaccacggtaccccgttagggggaaacggtacggaccccggtaagttaccggaacccgtaccggggtaccgttagttaacttacgtggtacggcggaaggtaggacggtcccggggacccgtaaaccggtaaccgtttaccgacgttccgtaaggtcgggaaccgttcggacgggggttacccgaacggggaaccccgtaaccgg

SEQ ID NO: 423273 - DNA, 564 bp, Homo sapiens
  misc_feature: GZ8MTXP01DMOWI.11.25.C03.1.454.CMB.2.raw
  modified_base (265)..(265): a, c, t, g, unknown or other
  modified_base (374)..(374): a, c, t, g, unknown or other
  modified_base (455)..(455): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtgtccccaggacagacagccagaactcccctgctctggaattgaattgagagataaatatacttgtgtatcaacagaanccaggccagtccctgtatgtcatctatcaagatgtagaacgccggaccctcgagggtactcccgtgacgccgtattctcgtcggcctaacccaactcgtaggggaaccncacgcccactcgtacgaccatccgacggccggaccaggctagtggatgagctagacttagttattgtcgaggtcgaggacngacagtctacgtcgtcccgttaagtcgttacgtacgggaacgtacgggaaccttaacgggttccttaccgttgtaggcgtacgaccgacccgaacggcccctaaacccg

SEQ ID NO: 423274 - DNA, 587 bp, Homo sapiens
  misc_feature: GZ8MTXP01AB11Q.11.25.C03.1.454.CMB.2.raw
  modified_base (174)..(174): a, c, t, g, unknown or other
  modified_base (192)..(192): a, c, t, g, unknown or other
  modified_base (293)..(293): a, c, t, g, unknown or other
  modified_base (370)..(370): a, c, t, g, unknown or other
  modified_base (422)..(422): a, c, t, g, unknown or other
  modified_base (507)..(507): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggtttcctgttgctattttaaaggngtcagtgtgaggtgcgtntggtggagtctggaggaggcctgatccagcgtgggggtcctgagactctctgtgcagcctcgtggttcaccgtcagtcacacctacagtgagttcgggccnccgaggctccggaggggaacgggctagggaggtgggttcttacctttattacaacgctagtggtatacagttctcgngaagccgtccgtaggaacggggcctattacaccatcacagacaactaacctnaaacgaactgctttagttactacgaaagagaacacgaccgacggagacgaccgacgacgacgacgtccgtagtattacgtgtcgngaagagacggtcggccgaacgtaacgttacgttacgacgtaagtcgaacggtcggcgggacggaacggaaccgaacccgg

SEQ ID NO: 423275 - DNA, 617 bp, Homo sapiens
  misc_feature: GZ8MTXP01CCZ93.11.25.C03.1.454.CMB.2.raw
  modified_base (298)..(298): a, c, t, g, unknown or other
  modified_base (400)..(400): a, c, t, g, unknown or other
  modified_base (442)..(442): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagtgggtcccnccgaggctccgaggggaagggctgggagtggtctctttatttacagtcagtgtagtactatattcgcagactccgtgcggggccattccaccatccacaganaacaactctaaagaaccacgtcttgtttctacaaatgaaacngcctaggacgacgccgatacgaccgaccggtcgttagtacttcgtggtacgcggaaggtacggacggtacccgggggacccctaaacggtaaccgtttaccgttaccgttcgttaacgggtccgggtaaccggttcggacgggggaacccctaaaccgggggcccctaaccgggg

SEQ ID NO: 423276 - DNA, 563 bp, Homo sapiens
  misc_feature: GZ8MTXP01BB5CX.11.25.C03.1.454.CMB.2.raw
  modified_base (358)..(358): a, c, t, g, unknown or other
  modified_base (369)..(369): a, c, t, g, unknown or other
  modified_base (406)..(406): a, c, t, g, unknown or other
  modified_base (538)..(538): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttggtccgccaggctccgaggggaggctggagtggtctcctttattacagcagtggtagtacatatcgnagactccgtgnggggccattcacatctcagacacaactctaagaaccngtcttgtttctacaaatgaaacagcctagggaagacgcccgaagtcgaaccgacggccgtagtacttacgtgtcgacggaagaggagtcggggccccaaaggtaacgttacacggctaagtcggaacgtcgnggggaccctaaggggcctaaccggg

SEQ ID NO: 423277 - DNA, 665 bp, Homo sapiens
  misc_feature: GZ8MTXP01AKPL1.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggctccgaggggaacgggcgtggagtgggtctcgtttatttacagcagtgtaagtacactattccgcagacctcccggtggaacggggccaattccaccatcctacccaagtacgaaccaaacctactaaaggaaaccacgtccttagttttacctacaaaattcgaaacacgcctaggggacggacgccgaacgtcggaaccgcccgggcgtttagtaactttacgtggttgaccggaaggaaacgcggttaccggggggacccctaaacgggtaaaccgtttaccgttaaccgttcgttaagtcggggtaaccgttcgggtcgggggacccggaaacggggttaacccgtaacccgggg

SEQ ID NO: 423278 - DNA, 581 bp, Homo sapiens
  misc_feature: GZ8MTXP01C9MZE.11.25.C03.1.454.CMB.2.raw
  modified_base (376)..(376): a, c, t, g, unknown or other
  modified_base (393)..(393): a, c, t, g, unknown or other
  modified_base (488)..(488): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgactccagccgtgggggtccctgagactctcctgtgcagcctcgtgggttcaccgtcagtcacacctacatgagttcggtcccgccaggcctccgaggggaagggctggagtggtcttctttatttacagtcagtgtagtacatctcgcagctccgngcgggccatccacatcncagacacaactcaaagacacgcttgtttactacaaatcgaaacacgcctaggggaacgacgccgaatcgaaccgcgggccgttagtacttaccgnggtcgaggtaagagacggtccggggaccctaaacggactttaacgcgttactaagtcggaacgtcggcgggaccgaacggaaccgtaaccggg

SEQ ID NO: 423279 - DNA, 712 bp, Homo sapiens
  misc_feature: GZ8MTXP01DA41J.11.25.C03.1.454.CMB.2.raw
  modified_base (281)..(281): a, c, t, g, unknown or other
  modified_base (369)..(369): a, c, t, g, unknown or other
  modified_base (397)..(397): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtcgtggtggagtcgtggaggaggcctgactccaggccgtgggggtccctgacgtactctcctgtgcagtcctcgtggtcaccgtnagtcacactacatgtagttcgggtccgccgaggccgtaccggagggggacgggcgtgggtaggttcgggtcttaccgtttatttacgngtctaggttggtatactactacttccgntaacgtaccgtccgggtagggcggggtcctacgttacccaacctacgttcctaccgaaagtacgaaacctaaacctacgtaaacgaacctacgtcctttacgttttactaacaaaagtacgaaaccagtcccgtaggggaacgacggtacccgaagtaccgaacgaccggtccgttagttaaacttcgtggtcggacgaaggaggttacggtaccgggggaaccctaaacggtaacgttacgacggttaccttaagggtccggaacggttcggggaccggggttaacccgtaacgggggaaccccgtaacccggg

SEQ ID NO: 423280 - DNA, 631 bp, Homo sapiens
  misc_feature: GZ8MTXP01D2ERK.11.25.C03.1.454.CMB.2.raw
  modified_base (290)..(290): a, c, t, g, unknown or other
  modified_base (304)..(304): a, c, t, g, unknown or other
  modified_base (377)..(377): a, c, t, g, unknown or other
  modified_base (422)..(422): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtcgtggtggagtcgtggaggaggcctgatccgagccgtgggggtccctgagtactctctgtgcagcctcgtgggtcaccgtcagtcacacctanatgagttcgggccnccgaggcctccggagggggacgggcgtggaggttcggtcttactttatttacagctagtggtatacatctcgnagcgtcgtggcgggctatcacatcacagacacactactaaagacncgtcttcgttactacaaatgaaacacgtcctaggggaacgacggtaaccagtacgaaccgtaccggccgttttttagaacttacgtggtacggacggaaggaggacgggtaccggggaccctaaacggtaaaccggttacgttacggttacgtaacggtacggggccgttacgggacgggggacccgtaaacggggcccgtaacccggg

SEQ ID NO: 423281 - DNA, 687 bp, Homo sapiens
  misc_feature: GZ8MTXP01DN85J.11.25.C03.1.454.CMB.2.raw
  modified_base (492)..(492): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagtcttgggttttccttgttgcttaattttaaaaggagtccagtgtgaggtgcgtctggtggagtagtggaggaggcctgactccagccgtgggggtccctgagactctcctgtgcagcctcgtcgggttcaccgtcagtcacacctacatgaggttcgggtccgccgaggcctccgagggggaagggctgggagtgggtcttcctttatttacagtacagtggtaagtactactacttccgacacgacctccggtggaacgggggccctaattccaacctatccctcaaggaacaacaaactcgaaaagaacctacgtcttagttttacctaacaaaattcgaaacncgcccgtagggaacgacgacccgtagtacggaaccgtaccggggtccgttaggttaacttaaccgtgggtaccggcggaaaggtacggacgggttccgggggaacccctaaacggtaaaccgtttaccgacgttcgttaaggtacggggaaccgttcggtacgggggacccctaaacgggggcccctaacccggg

SEQ ID NO: 423282 - DNA, 699 bp, Homo sapiens
  misc_feature: GZ8MTXP01EEIYG.11.25.C03.1.454.CMB.2.raw
  modified_base (176)..(176): a, c, t, g, unknown or other
  modified_base (232)..(232): a, c, t, g, unknown or other
  modified_base (280)..(280): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctcgatgagttgactcagccaccctnagtcgtccgtgtcccaggacagacagccagactccctgctctgaattgattgaganaataatatacttgtgtatacaacagaagcagccacgtccctgtatgtnatctatacaagtatgtagaacgccggcctacgagggtactcccgtagacgtccgtattctcgtcggtcctaaccctaacgtcggtacgggaaaccgccgacgccctacgtacgtacgaacctatccgacgggacccgggaaccgaggtacttagtggagtaggacgctagtaccttagtttagttcgggtacgacgggtacgggtagggaacccaggtaccacggtacccgtaccggtttaccggttccccgggttttaagttccgggtttacccgggtttaaaccggggttaaaccggttaaccgggggaaacccgttaaacggggttccccgttaaaccgggtttccgtttaacggaaccggttaacccgaacccggttacccccggtaaacccgggaaccccctaaaaccccccgg

SEQ ID NO: 423283 - DNA, 651 bp, Homo sapiens
  misc_feature: GZ8MTXP01ANCQE.11.25.C03.1.454.CMB.2.raw
  modified_base (300)..(300): a, c, t, g, unknown or other
  modified_base (353)..(353): a, c, t, g, unknown or other
  modified_base (373)..(373): a, c, t, g, unknown or other
  modified_base (385)..(385): a, c, t, g, unknown or other
  modified_base (410)..(410): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctctgggttcaccggtcagtcacacctacatggagttgggtcccncaggcctccgaggggaagggctggagtgggtctctttattacagcagtggtanacatatcgcagactccgggnggcggcatcacntcacagacacaactacgtaaagacncgtcttgtttactacgaaatcgaacagtaccgagggaacggacgccgtaagtcgaaccggtaccgggtaccgttagttaacttaccgtggtacggcgggaaggtaacggttaccgggtaccgggggaaccccgtaaaccgggtaacccgtttaccgttaaccgggttacttaacgggtaccggggtaaccgttccggggtaccggggggaaccccgtaaaccgggggccccgtaacccggg

SEQ ID NO: 423284 - DNA, 747 bp, Homo sapiens
  misc_feature: GZ8MTXP01CFO3W.11.25.C03.1.454.CMB.2.raw
  modified_base (343)..(343): a, c, t, g, unknown or other
  modified_base (398)..(398): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggtttttccttgttgacttaattttaaaaggagtccagtgtgaggtgcgtcgtggtggagtcgtggaggacggcctgactccgacggtccggttcgggggggtccctggacgtaccttccgtcctggtcgctacgtcccttcgttcgggttccacccgttcagtccacacctacagtgacgttcgggtcccnccgaggctaccggagggggagggcgtgggagttggttccttaccttttatttacngtacgtagtaggtagtaactacttacttccgacacggaccgtccgggtagggaacggggccgtaacttccacctacttcccgacaacggaacgtaacaaaccgtacgtaaaacgaacctacggtctttacgtttactaacgaaagttcgaaacctacgccgttaggggaacgtacgacccggtaatacggaaccgtacggtccgttagttaaacttcgtggtcggacgaaggacggttacgtcccggggaacccgtaaacgttaaccggttacaccggttcgtaaagggtccgggtaacggttcccgggacgggggaacccgaaaccgggggttcccgtaaccccgggg

SEQ ID NO: 423285 - DNA, 659 bp, Homo sapiens
  misc_feature: GZ8MTXP01BV5Q5.11.25.C03.1.454.CMB.2.raw
  modified_base (347)..(347): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgatccaggccgtgggggtccctgacgactctcctgtgcagcctcgtgggttcaccgtcagtcacacctacatgagttcggccgcgaggctaccgaggggagggctggagtggtcttctttatttacngcagtgtagtacatacttcgcacgacctcggtgaacggggccattccaccatctaccgaagacgaactaactacgtaaagaacctacggtactttcgttttactaactaaaagtacgaaacacgtccctaggggaacgacggaccgagtacgaccgacggtccgttagtacttacgtggtcgcggaagacggttacgggtaccggggacccctaaacgggtaaacccgttacgttaccggttacgttaaggtacggggtaaccgttccgggtacgggggaacccggaaaacggggttccccgtaacccgggg

SEQ ID NO: 423286 - DNA, 944 bp, Homo sapiens
  misc_feature: GZ8MTXP01ERXQP.11.25.C03.1.454.CMB.2.raw
  modified_base (182)..(182): a, c, t, g, unknown or other
  modified_base (324)..(324): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagcttgggtttttccttgttgcttaattttaaaaggngtccagtgtgaggtgcgtcgtggtggagtcgtggaggaggcctgactccgaggtccgtcgggggtccctgacgactctccgtgtgcacgtcctcgtcgggttccaccgtcagtccaacacctacagtgaggttcgggtcccnccgaggcctaccggaaggggggaacggggtcgtaggggtaggttcggggttcctttaccgttttaatttaacgacggtcgtaagggttacggttaaacgtaacctaacgtttaccgttaccggacgtaaacggtacccgttcccggggttaggggaaccggggggtaccctaaacgttcccaaaccctacttacccgtacccgaaaggtaaccgaaaccttaaacctacgtaaaacgaaaccctacggtttacctttacgggttttttaaccctaaaccgaaaaagttacgaaacccgtaacggtccccgttaaggggaacgggtaacccggtaacccggtaagtaccggtaaacccggtacccggggttacccgtttaaggtttaaacgtttaacccgggtgggttaaccgggaaccgggtaaagggtaacggggttaaccgggggtaccccggggggttaaacccccctaaaacggggtttaaaaccccggtttaaacccgttccgggttaaacccggttttaacggggtaccgggggttaaaccccggtttaccgggggtacccggggggaaaccccggtaaaacccggggggttaacccccggttaaaccccgggg

SEQ ID NO: 423287 - DNA, 613 bp, Homo sapiens
  misc_feature: GZ8MTXP01EXG8W.11.25.C03.1.454.CMB.2.raw
  modified_base (302)..(302): a, c, t, g, unknown or other
  modified_base (361)..(361): a, c, t, g, unknown or other
  modified_base (512)..(512): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgactccagccgtgggggtccctgagactctctgtgcagcctcgtgggttccaccgtcagtcacacctacatgagttgggccncgagctcgaggggaggctggagtggtctctttatttacagcagtgtagtacatactcgnagacctccggtgaacggggcctatccacctatcctcaagacaacaactcgtaaagaacacgtcttacgttttactaacaaaagtcgaaaacgcgtacccgtaggaacggacgacccgaatcggaaccgacgggtccgtaagttacttacgnggtacgagaagtagacggtcggggaccccaaaggtaaccgttacgacgcgttaagcgggtaaccgtggcgggggaacctaacgggggttaacccaaccggg

SEQ ID NO: 423288 - DNA, 621 bp, Homo sapiens
  misc_feature: GZ8MTXP01CWJBD.11.25.C03.1.454.CMB.2.raw
  modified_base (220)..(220): a, c, t, g, unknown or other
  modified_base (300)..(300): a, c, t, g, unknown or other
  modified_base (340)..(340): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctntggaattgaattgagagataaatatacttgttggtatcaaacagaagcaggccagtccctgtattggtcatctatcaagntgtgaagcggccctgagggctcccgtgacgtccgtattcncgtcggacctaaccaaactcggtacgggaaaccgccgaacgccccaacgtcctacggaacccagtacccgaacggcccgggaaccccaaggggtacctacggtagggattggaagggtcccgttaagtaccgttaaggttttaacttggttccgagggtcggtggggaccaggaccgagtcaacgtcgcccgttaagtcgttcggttaccggagttacggggacttaacgggttcacccgttgttaggcgttagaccgacccgtaacggccctaaaccccg

SEQ ID NO: 423289 - DNA, 633 bp, Homo sapiens
  misc_feature: GZ8MTXP01A24P5.11.25.C03.1.454.CMB.2.raw
  modified_base (279)..(279): a, c, t, g, unknown or other
  modified_base (291)..(291): a, c, t, g, unknown or other
  modified_base (310)..(310): a, c, t, g, unknown or other
  modified_base (374)..(374): a, c, t, g, unknown or other
  modified_base (455)..(455): a, c, t, g, unknown or other
  modified_base (511)..(511): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagtttggctgagcttgggttttccttgttgcttaattttaaaaggagtccagtgtgaggtgcgtctggtggagtcgtggaggaggcctgatccgaggccgtgggggtccctgagactctcctgtgcagcctcgtgggttcaccgtnagtcacacctantgagtcggtccgccaggcnccgaggggaggcgtggagtggtcttctttattacagcagtgtatacatactcgcagactccggnggaacggggcctattccaccatcctaccgagacactaacgtactaaagacctacgtcttagtttacctacaaatcgaaacngtccctaggggaacggacgacccgatcgaaccgaccggtccgttagtacttaccgnggtacgacggtaaggacgcgggtacccggggaaccctaaacgggtaaaccttaccgttcgttaccgtaaggtacgggtaacccgtcgggacgggggttacccaacggggcccgtaacccggg

SEQ ID NO: 423290 - DNA, 605 bp, Homo sapiens
  misc_feature: GZ8MTXP01E1KPT.11.25.C03.1.454.CMB.2.raw
  modified_base (276)..(276): a, c, t, g, unknown or other
  modified_base (340)..(340): a, c, t, g, unknown or other
  modified_base (358)..(358): a, c, t, g, unknown or other
  modified_base (366)..(366): a, c, t, g, unknown or other
  modified_base (368)..(368): a, c, t, g, unknown or other
  modified_base (379)..(379): a, c, t, g, unknown or other
  modified_base (382)..(382): a, c, t, g, unknown or other
  modified_base (387)..(387): a, c, t, g, unknown or other
  modified_base (395)..(395): a, c, t, g, unknown or other
  modified_base (403)..(403): a, c, t, g, unknown or other
  modified_base (428)..(428): a, c, t, g, unknown or other
  modified_base (478)..(478): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtgggtcaccgtnagtcacactacatgagtcggtccgccaggctcgaggggaggctggagtggtctcctttattacngcagtgatacactatcgnagactcgngngggccatcacntcncaganacaactanaaagaacngtcttgttactacaaatcgaaaacngcagggacgacgtacgagtacgaaccgtcggtacgttagttacgttacgnggtacggaacggaaggacggttacgggtacccgggaaacccgtaaacggttaacgttaccgttacgttacgtaaggcggtaaccggtcgggaccggggaacccgtaaaccgggttaacccgtaacgg

SEQ ID NO: 423291 - DNA, 573 bp, Homo sapiens
  misc_feature: GZ8MTXP01AKERK.11.25.C03.1.454.CMB.2.raw
  modified_base (263)..(263): a, c, t, g, unknown or other
  modified_base (296)..(296): a, c, t, g, unknown or other
  modified_base (365)..(365): a, c, t, g, unknown or other
  modified_base (537)..(537): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtgtatcaacagancaggccagtccctgtattggtcatctatcaagntgtgaagcggccctcgagggactcccgtgacgccgtattctcgtcggctaccaactcgtaggggaaccncgacgcctactctacgaccataccgacggccgggaacccaggactagtaggagtcggagtccgtagtacttagtttagttggtcgagggtcgtagggacaggcagtcctacgtcgtcccgttaatcgttcggttaccggagttacgggaaccgttacggttccttaccgttntggcgtcgaccgttaccccgaacgcccgtaaacccc

SEQ ID NO: 423292 - DNA, 749 bp, Homo sapiens
  misc_feature: GZ8MTXP01DNWMY.11.25.C03.1.454.CMB.2.raw
  modified_base (634)..(634): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagtcttgggtttttccttgttgtacttaattttaaaaggagtccagtgtgaggtgcgtcgtggtggagtcgtgggaggaggcctgactccgaggccgtcggggggtccctgacgtacctctcctgtcgcacgtcctcgtcggtccaccgtcacgtcacaacctacagtggtaggttcgggcccgaccgacggcctaccggaaggggggaacggggcgtggggtaggtttcgggttaccttttaccgtttttaagtttaaccaggtacgtaggttaggtaaagttacctaacttacgttccgacgtacggtaccgtacccgggtaggggaacgggggtccctacttacccaccacttaccctaccgaaggaaccaacctaaaccttaactaaacgaacctcgttactttcgttttactaacgaaatcgaaacagtccgtaggggacgacgaccgtagacgaaccgtcggaccgttagttactttacgggnggtacggaggaaggaacggttcgggtaccgggaaacccgtaaacggttaacgttacgcgttacgtaaggtcggtaaccgggtcgggaccggggaccgtaaccgggttccgtccgg

SEQ ID NO: 423293 - DNA, 623 bp, Homo sapiens
  misc_feature: GZ8MTXP01CY0QD.11.25.C03.1.454.CMB.2.raw
  modified_base (307)..(307): a, c, t, g, unknown or other
  modified_base (376)..(376): a, c, t, g, unknown or other
  modified_base (399)..(399): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctgggaggaggcctgactccaggccgtggggggtccctgagactctcctgtgcagcctcgtggttcaccgtcagtcacacctacatgagttcgggtccnccgaggcctccgaggggaagggctggagtgggtctcctttatttacagcagtggtagtacactatccgnagactcggtgcgggccattcacntctcagacacaactcaaagaacctacgtcttgtttctacaaatcgaaacacgcctggggaacgacgacccgatcgaaaccgccgggtccttaggttaattaaccgtgtcgaacggtaaggaagacgggtccggggacccaaacggtaaccgtttaccgcggttactaaggtcggggaacgttccggggacgggggaacccgtaacgggggccccgtaacccggg

SEQ ID NO: 423294 - DNA, 631 bp, Homo sapiens
  misc_feature: GZ8MTXP01CJQB1.11.25.C03.1.454.CMB.2.raw
  modified_base (302)..(302): a, c, t, g, unknown or other
  modified_base (450)..(450): a, c, t, g, unknown or other
  modified_base (461)..(461): a, c, t, g, unknown or other
  modified_base (582)..(582): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggtccaccgtcagtcacacctacatggagttcgggccnccgaggcctccgaggggagggctgggaggttgggtccttcgttttatttacagctagtggtagtacacttactccgcagcctccgggtggcggggccattcacatctacagacaccaactactaaagaacacgtcttagtttcctaanaaatcgaaacncgcctaggggagacgccgtatcgaaccgcgggtccgttagtaacttaccgtgtcggacggaaggtaacgggacggttaccgggggacccctaaacgggtaacgttaccgacgcgttaaggngggtaacccgggtcgtacggggggacccaaacgggggcccctaaccggg

SEQ ID NO: 423295 - DNA, 571 bp, Homo sapiens
  misc_feature: GZ8MTXP01AJE69.11.25.C03.1.454.CMB.2.raw
  modified_base (300)..(300): a, c, t, g, unknown or other
  modified_base (461)..(461): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggtccnccaggctccgaggggaagggctggagtgggtctctttatttacagcagtggtagtacatatcgcagactccgtgcggggccattcaccatctccagagacaactcaaagaacacgtcttgtttctacaaatgaaacagcctaggagagccgaatcgaaccncgggccgttagtacttacgtgtgcggaagagacggtcggggacccaacggtaacgttcgacggctaagtgggaaccgttcggacgggggaccaacggggccctaaccggg

SEQ ID NO: 423296 - DNA, 613 bp, Homo sapiens
  misc_feature: GZ8MTXP01EFZT8.11.25.C03.1.454.CMB.2.raw
  modified_base (304)..(304): a, c, t, g, unknown or other
  modified_base (343)..(343): a, c, t, g, unknown or other
  modified_base (363)..(363): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgagccgtgggggtccctgagactctctgtgcagcctcgtgggtcaccgtcagtcacacctacatgagttcggccncaggctcgaggggaggctggagtggtcttctttattacngcagtgtagtacatactcgnagactccgtgcggggctatccacatctacagacaactaactactaaagaacacgtcttagtttactacaaatcgaaacagtccctaggggaacgacgtacccgaatcggaaccgtaccgggtcgttaggttacttaccgtggtacgcggaagaggacggtccggggacccctaaacggtaaaccgttacgttacggccttaaggtcggtaacgttcgggacggggacccgaacgggaacccgtaacccgg

SEQ ID NO: 423297 - DNA, 588 bp, Homo sapiens
  misc_feature: GZ8MTXP01B8KJ0.11.25.C03.1.454.CMB.2.raw
  modified_base (368)..(368): a, c, t, g, unknown or other
  modified_base (380)..(380): a, c, t, g, unknown or other
  modified_base (405)..(405): a, c, t, g, unknown or other
  modified_base (444)..(444): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttgggtccgccaggctccgaggggaagggctgggagtgggtcttcctttatttacagcagtggtagtacatattcgnacactccgtggngggggcctattcaccatctccaganacaactctaaagaacacgcttgtttctacaaatgaaacngactagggacgacgccgatcgaccgtacggcgttagtacttcgtggtcgcggaagaggacgggtccgggacccgtaaacggtaaccgttacgttacgcgtaagcgggtaacgtcgggtacgggaaccgaacgggaacccgaacg

SEQ ID NO: 423298 - DNA, 614 bp, Homo sapiens
  misc_feature: GZ8MTXP01DU76V.11.25.C03.1.454.CMB.2.raw
  modified_base (383)..(383): a, c, t, g, unknown or other
  modified_base (511)..(511): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaggagtccagtgtgaggtgcgtcgtggtggagtcgtggaggaggcctgatccagccgtgggggtccctgagactctcctgtgcagcctcgtgggtcaccgtcagtcacacctacagtgagttcgggtcccgccgaggctaccggagggggaaggggcgtggggtagttggggttccttccgttttatttacgagcagttggtatacatactcgnagactccggtgcgggctatcacatctacagacaacaactctaaagaccacgtcttagtttctacgaaatcgaaacagcctagggaacgagcccgaagtcgaaccgcgggtccttagttacttacgtgnggcgaaagcggttagtccgggggacccctaaaggtaaccgttacgacgcgtaagtacgggaaccggttcgcgggggttaacctaaacgggggccctaaccggg

SEQ ID NO: 423299 - DNA, 729 bp, Homo sapiens
  misc_feature: GZ8MTXP01DN640.11.25.C03.1.454.CMB.2.raw
  modified_base (177)..(177): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtcgtggaggaggcctgatccagccgtgggggtccctgagactctcctgtcgcacgtcctcgtgggttccaccgtcagtcacacctacatgaggttcgggtcccgccgaggcctaccggagggggaacgggcgtggggaggttgggtcttcctttatttacagtctagttaggtagtactacttacttccgcaacgtaccgtcccgggtagggaacgggggtcctaactttacccgaaccctacgtcctacccgaagacgtaactaaacctacgtaaacgaaaccaccgtctttagtttcctaacaaatacgaaacacgtcccgtaggggaacgacggacccgtaagtacgaacccgtccggccgtttaggttaacttaccgtggtggccggaaaggtcgacgggttaccgggggaacccctaaacggttaaccggtttaaccgttaccggttacgttaacggtacgggtaaccgggttcgggtaccggggggaaccccgtaaacgggggccccgttaacccgggg

SEQ ID NO: 423300 - DNA, 601 bp, Homo sapiens
  misc_feature: GZ8MTXP01CU5QH.11.25.C03.1.454.CMB.2.raw
  modified_base (376)..(376): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaacgccggccctcgagggactcccgtgacgccgtattctcgtcggtcctaacccaactcgtagggaaaccncagcccactctacgaccatcgacggccgggacccaggctagtggactaggaggtctagtacttaagtttagttacggtcgaagggtcggtagggacaggcacgtccgtaacgtcgtcccggttaagtcggttacggttccgggaaacgttcggggaacccgttaaggttccgttaccgttgttacggaacgtcgaccggaccccgaaaccggcccctaaaccccg

SEQ ID NO: 423301 - DNA, 572 bp, Homo sapiens
  misc_feature: GZ8MTXP01EQLT5.11.25.C03.1.454.CMB.2.raw
  modified_base (261)..(261): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctntgggttcaccgtcagtcacacctacatgagttgggccgccaggctccgaggggaggctggagtgggtctctttatttacagcagtggtagtacatactcgcagactccgtggcggggccattccaccatcctccagacgaactaactacaaacgaacacgtacttgtttacttacaaatcgaaacagcctagggacgaggccaagtgaaccaccgggtcctagtacttactgtgcgaagagagtcggggaccaacggtaacttacgacgcctaagtgaacgtcgtggggacctaagggaaccctaaccggg

SEQ ID NO: 423302 - DNA, 604 bp, Homo sapiens
  misc_feature: GZ8MTXP01E2M3D.11.25.C03.1.454.CMB.2.raw
  modified_base (389)..(389): a, c, t, g, unknown or other
  modified_base (418)..(418): a, c, t, g, unknown or other
  modified_base (468)..(468): a, c, t, g, unknown or other
  modified_base (513)..(513): a, c, t, g, unknown or other
  modified_base (564)..(564): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgactccagccgtgggggtccctgagctctcctgtgcagcctcgtgggttccaccgtcagtcaacacctacatgagttcgggcccaccgaggcctaccggagggggaaggggcgtgggaggttcgggttccttcctttaatttacagctaggtggtatacactactccgnagcgtccggtgcggggcctatccacatcnccaagacaacaactctaaagaactacgtcttgtttacacaaatcgaaacngcctaggggacacgccgatcgaccgacggtccgttagtattacgnggtcgcgaagagttacggtcggggaccccaaaggtaaccgttacgacgttntaagtcggaacgtcggcggggactaacgggccctaaccgg

SEQ ID NO: 423303 - DNA, 802 bp, Homo sapiens
  misc_feature: GZ8MTXP01EH8G1.11.25.C03.1.454.CMB.2.raw
  modified_base (353)..(353): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgactccagccgtgggggtccctgacgtactctcctgtgcacgtcctcgtgggttcaccgtcagtcacacctacatgagttcgggccgccaggctccgaggggagggcgtggagtggtcttctttatttanagctagtggtaagtacacttacttccgacgagtacccgtcccgggtagggaacgggggtccctaacgtttaccaaccctacttccctacccgaaaggaaccgtaaactaaaacccgttacgtaaaaacggaaacccgtacgttaccgttttaacggtttttaccctaaacgtaaaaaacgttacggtaaaaaccacgggtaccccgttaaggggggaaacgaacgggtaccccggtaaagttacggaaacccgtacccgggggttccgtttaaggtttaaacgttaacgtggttacggggcggtaaaagggtacggaacggggtcccgggggttaaacccccaaaacgggttaaacccgttttaaaccgaaccgttccgtaaaggtcgggggtaaccggtcgggtaccggggggaacccgtaaacggggggttaacccctaacccgggg

SEQ ID NO: 423304 - DNA, 630 bp, Homo sapiens
  misc_feature: GZ8MTXP01AQLU1.11.25.C03.1.454.CMB.2.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtgggggtccctgagactctcctgtgcagcctctgggtccaccgtcagtcacacctacatgagttgggcccgcaggctccgaggggaagggctggagtgggtcttccgtttattacagctagtggtagtacatacttcgcagaccgtccgtggaacggggccattccaccattccacagagacaactctaaacgaacacgtcttgtttactacaaaattcgaaactcgacccgtagggacgacggccgagtacgaacgccgggtccgttgtacttaccgtggtcgcggaagaacggacggtccgggggacccctaaacggtaaaccgttcgacggttaccgtaaggtcgggaaccggttcgggtaccggggggacctaaacgggggccccgtaacccgggg

SEQ ID NO: 423305 - DNA, 580 bp, Homo sapiens
  misc_feature: GZ8MTXP01EFWSL.11.25.C03.1.454.CMB.2.raw
  modified_base (238)..(238): a, c, t, g, unknown or other
  modified_base (258)..(258): a, c, t, g, unknown or other
  modified_base (453)..(453): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtcgtccgtcgtccccaggacagacagccagactcccctgctctgaattgaattgaganataatatattgtgtatcaanagagcaggccacgtccctgtattgtacatctatacaagtatgtagaacgcccgaccctcggagggactcccgtagacgtccgtattcgtcgtcgcctaacccgaactcggtagggaaaccgcacgccctactctcgaccatcgacggccggacccgaggtactagtggagtgagctagtactagttagtgtacgnggcgtgggacaggctagctacgtcgtcccgttaagtcgttacgtacggttaacgtccgggtaaccttaagggttcccttacggtcgttaggaaccgtcgaccggttaccctaacggcccctaacccg

SEQ ID NO: 423306 - DNA, 680 bp, Homo sapiens
  misc_feature: GZ8MTXP01EIFR4.11.25.C03.1.454.CMB.2.raw
  modified_base (266)..(266): a, c, t, g, unknown or other
  modified_base (268)..(268): a, c, t, g, unknown or other
  modified_base (298)..(298): a, c, t, g, unknown or other
  modified_base (311)..(311): a, c, t, g, unknown or other
  modified_base (381)..(381): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggtagttttggctgagtcttgggtttttccttgttgacttaattttaaaaaggagtccagtgtgaggtgcgtcgtggtggagtcgtggaggaggcctgactccgagccgtgggggtccctgagactctcctgtncngcctcgtggtccaccgtcagtcacacctanatgagttcggccncgaggctacgaggggaggctggagttggtcttctttatttacagctagtggtaagtactactacttccgnacgaccgtccggtggcggggcctattccacctatcctacaagacaactaactactaaagaacctacgtcttcgttttactacaaaatcgaaacacgtccgtaggggaacgacggtcccgaagtacggaaccgtccgggtccgttaaggttaacttacggttggacggacggaaggtaacggacgggttaccgggggacccctaaacgggtaaacccgttttaaccgacggttaccgttaagggtcgggtaaccggttcgggtacgggggacccgtaaaccggggttcccgtaacccggg

SEQ ID NO: 423307 - DNA, 535 bp, Homo sapiens
  misc_feature: GZ8MTXP01D2IVW.11.25.C03.1.454.CMB.2.raw
  modified_base (289)..(289): a, c, t, g, unknown or other
  modified_base (301)..(301): a, c, t, g, unknown or other
  modified_base (359)..(359): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (386)..(386): a, c, t, g, unknown or other
  modified_base (394)..(394): a, c, t, g, unknown or other
  modified_base (397)..(397): a, c, t, g, unknown or other
  modified_base (402)..(402): a, c, t, g, unknown or other
  modified_base (450)..(450): a, c, t, g, unknown or other
  modified_base (487)..(487): a, c, t, g, unknown or other
tcagcgagagataccacgaccggtgctcgatttagtagtgtagatttgggtttggggggagaggagccccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgatccgagccgtgggggtccctgagactctcctgtgcagcctcgtgggtcaccgtcagtcacacctanatgagttggccncgaggctcgaggggaggctggagtggtctctttattacagtcagtgtatacatatcgnagctcgngcgggcatcacntcncananacatcaanacnctctnttctacaatgaacacgcagggagagcgatgacgcggtctagtctctgngacgaagcgagtccggggaccaacggtaaccgttacncgactaagtcggaacgttcggcggggaccgaacggggcccgtaaccgg

SEQ ID NO: 423308 - DNA, 670 bp, Homo sapiens
  misc_feature: GZ8MTXP01A51K3.11.25.C03.1.454.CMB.2.raw
tcagcgagagataccacgaccggtgctcgatttagtagtgtagatttgggtttggggggaggaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggtccgccgaggctaccggagggggaagggcgtggagtgggtcttctttatttacagctaggtggtagtacactacttccgacacggacctccggtgggaacgggggtccctattccacccgtattccctaccgaagacgaacctaaacgttacgtaaacgaaacctacggtctttacggttttacctaaccgaaaattcgaaacctagtacccgtaggggaacgtacgcccggtaatacggacccgtacggtccgttagttacttaccgtgtcggacgaagagttacggtccggggacccaaacggtaacgttacgcgacgtaagtcgggtaacgttcgggcggggttaacccgaacgggaacccgtaaccggg

SEQ ID NO: 423309 - DNA, 692 bp, Homo sapiens
  misc_feature: GZ8MTXP01DC2JR.11.25.C03.1.454.CMB.2.raw
  modified_base (293)..(293): a, c, t, g, unknown or other
  modified_base (406)..(406): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccagccgtgggggtccctgagtactctcctgtgcagcctcgtgggtcaccgtcagtcacacctanagtgaggttcgggccgccgaggccgtccggaagggggacgggcgtgggtacggttcgggttcctttccgttttatttaacgagtcgtaaggttggtagtactattacttccgngacgaccgttccgggtaggcgggggcctacttacccaacctactcctacgaagaacgaactaaactactaaagaaccacgtctttgttttactaacaaatacgaaacacgccgtaggggaacgacggaccgtagtacgaaccgtacgggtccgttagttaacgttcgtggtcggacggaaggacgacgggtcccggggaacccaaacgggtaaacgttacgttacgttacgtaaggtcgggaaccggttcgggaccggggaccgtaaaccgggggccctaaccggg

SEQ ID NO: 423310 - DNA, 669 bp, Homo sapiens
  misc_feature: GZ8MTXP01CZPP5.11.25.C03.1.454.CMB.2.raw
  modified_base (406)..(406): a, c, t, g, unknown or other
  modified_base (558)..(558): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcgtggttttcttgttgctatttaaaaggagtccagtgtgaggtgcgtcgtggtggagtcgtggaggaggcctgactccagccgtgggggtccctgacgactctcctgtgcagcctcgtcgggttcaccgtcagtcacacctacagtgaggttcgggccgaccgaggccgtaccggaaggggggaacggggcgtaggggtaggttcggggttcctttacgttttaatttacgagctaggttggagttacagttactccgnacgtaccgtccgggtaggcggggcctattccacactcaccgaagacaacaaacctacgtaaagaaccgacgtctttcgtttacttaacgaaagcaaacgtacgtccgagggaacgagccgaagtcgaccgacggtccgttagttaacgttcnggtcgaggaaggagcggtcggggaaccctaaacgggtaaccgttacgttcggttactaaggtacgggtccgttcgggacggggacccgtaacggggaacccgtaacccggg

SEQ ID NO: 423311 - DNA, 607 bp, Homo sapiens
  misc_feature: GZ8MTXP01A90J9.11.25.C03.1.454.CMB.2.raw
  modified_base (296)..(296): a, c, t, g, unknown or other
  modified_base (357)..(357): a, c, t, g, unknown or other
  modified_base (508)..(508): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacactacatgagttggccncaggctccgaggggaggctggagtcggtctctttattacagcagtgtagtacatactccgnagacctccggtgcggggccattcacctatctaccagacgacaaactcaaacgacacgtcttagtttctacgaaatcgaaacacgcctaggggaacgtacgacccgagtacgaccgtacgggcccgttagttacgtacgtggtgacgggaanacggaacggtcccggggaaccccgtaggaaaacccgtttcgaccgttctaaggtcgggaacgttcgggacgggggacccaaaggggcccgtaacccggg

SEQ ID NO: 423312 - DNA, 665 bp, Homo sapiens
  misc_feature: GZ8MTXP01CGW37.11.25.C03.1.454.CMB.2.raw
  modified_base (356)..(356): a, c, t, g, unknown or other
  modified_base (383)..(383): a, c, t, g, unknown or other
  modified_base (442)..(442): a, c, t, g, unknown or other
  modified_base (469)..(469): a, c, t, g, unknown or other
  modified_base (525)..(525): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggagcctgatccagccgtgggggtccctgagactctcctgtgcagcctcgtgggtcaccgtcagtcacacctacatggaggttcgggtcccgccgaggcctccgagggggaacgggcgtgggaggttgggtcttcctttatttacngcaggttggtagtactacttactccgnagcctaccggtggcggggccgtattccacatcctccagacgaacaactactaaagaacncgtactttgtttctacaaatcgaaacngcctggggaagacgtccgaagtagacccgtacggggcctttaggtaactttaccgnggttcgacggtaaggaacggcgggttacccgggggcccctaaaacgggtaaccgttttaacccgacgccgtttaaaggcgggggtaacccggttcggtacggggggaacccctaaaacgggggcccccgttaaaccgggg

SEQ ID NO: 423313 - DNA, 619 bp, Homo sapiens
  misc_feature: GZ8MTXP01A0U1B.11.25.C03.1.454.CMB.2.raw
  modified_base (362)..(362): a, c, t, g, unknown or other
  modified_base (448)..(448): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctcgggttcaccgtcagtcacacctacatgaggttgggccgccaggctccgaggggagggctggagtggtctctttatttacagcagtggtagtacatactcgnagactccggtgcggggccattccacatctacagacacaaacgtctaaacgaacacgtctttagtttaccttacaaaatgaaaaccncgtactaggggaacgacgaccgatacgaccgtacggtacgttagttacttacgtggtcgcggaagaggttacggtccggggaacccctaacgggttaaacgtttacgccgttacgtggtacgggaacgttccggggacggggacccgtaaacgggggttcccctaaccggg

SEQ ID NO: 423314 - DNA, 600 bp, Homo sapiens
  misc_feature: GZ8MTXP01EOYXL.11.25.C03.1.454.CMB.2.raw
  modified_base (520)..(520): a, c, t, g, unknown or other
  modified_base (557)..(557): a, c, t, g, unknown or other
  modified_base (576)..(576): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtccctgagactctcctgtgcagcctctgggtcaccgtcagtcacacctacatgagttgggcccgcaggctccgaggggaagggctggagtgggtcttcctttatttacagctagtgtagtacatacttccgcagacccgtccgtggaacgggggcctaattccgaaccctattcctaccgaagacgaaccaaactactaaagaacctacgtcttgttttactacaaatgaaacagcctggggaagcgaccgatcgacgaccggtcgtagttatacgtgtcgnggtaagagaggtccggggaccccaaagtaacgttacngctaagtcggaacgttcgngggggacccaaggggccctaacgg

SEQ ID NO: 423315 - DNA, 637 bp, Homo sapiens
  misc_feature: GZ8MTXP01BPLVC.11.25.C03.1.454.CMB.2.raw
  modified_base (367)..(367): a, c, t, g, unknown or other
  modified_base (371)..(371): a, c, t, g, unknown or other
  modified_base (380)..(380): a, c, t, g, unknown or other
  modified_base (399)..(399): a, c, t, g, unknown or other
  modified_base (445)..(445): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggttcaccgtcagtcacacctacatgagttcgggtccgccgaggctccgaggggaaggggctgggagtgggtcttctttatttacagcagtgtagtacatntcgnagactccgngcggggccattcaccatcncagacacaactacaagaacacgtcttgtttactacaaatcgaaacngcccgtaggacgacgcccgaagtcggaaccgtaccggggaccgttagttaacgtttacgtggtacggcggaaggtagacgggttcgggggacccctaaacgggtaaaccgtttaccgaacgttccgttaaggtcgggtaacccggttcgggacggggggaaccccgaaagggggttaaccccgtaacccggg

SEQ ID NO: 423316 - DNA, 568 bp, Homo sapiens
  misc_feature: GZ8MTXP01DDBH6.11.25.C03.1.454.CMB.2.raw
  modified_base (243)..(243): a, c, t, g, unknown or other
  modified_base (259)..(259): a, c, t, g, unknown or other
  modified_base (371)..(371): a, c, t, g, unknown or other
  modified_base (383)..(383): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaatgagagataaatntacttgttgtatcaanagagcagccagtccctgtatgtcatctatcaagatgtagaacgccggccctgagggtactcccgtgacgccgtatttctcgtcggcctacccaacgtcgtacggggaaaccncacgcccactcncgaccagtcgacggccgggacccaggctagtgatggacgctagtacttagtttagttgtcgagggcgtggacacgacgagcacgtcggtcccgttaagtcgttacgttacgggacgtacgggaaccttaacggttccaccggttcgtacgtcggtaccacggaccccaacggcccctaaaccccg

SEQ ID NO: 423317 - DNA, 600 bp, Homo sapiens
  misc_feature: GZ8MTXP01A58GJ.11.25.C03.1.454.CMB.2.raw
  modified_base (284)..(284): a, c, t, g, unknown or other
  modified_base (297)..(297): a, c, t, g, unknown or other
  modified_base (366)..(366): a, c, t, g, unknown or other
  modified_base (376)..(376): a, c, t, g, unknown or other
  modified_base (401)..(401): a, c, t, g, unknown or other
  modified_base (419)..(419): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcacgtcagtcacactacntgagtcgggtccnccaggcctacgaggggagggctggagtgggtctcccctttatttacagcagtggtaagtacactatcgnagacgtccgnggcgggccattcacatctaccaganaacaactactaaagaacncgtacttgtttactacaaaatgaaaccagccctagggaacgacggaccagtcgaacgacggccgtagttactacgtgtgcgaaggagacgtcggggaccccaacgaaaccgtttacgccggttacttaaggacgggtaaccggtcggtacgggggaccccgtaacggggaaccctcccggg

SEQ ID NO: 423318 - DNA, 786 bp, Homo sapiens
  misc_feature: GZ8MTXP01ECYYD.11.25.C03.1.454.CMB.2.raw
  modified_base (295)..(295): a, c, t, g, unknown or other
  modified_base (638)..(638): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccgagccgtgggggtccctgagactctcctgtgcacgcctcgtcgggtcaccgtcagtccacacctanagtggaggttcgggcccgccgaggcctacggagggggaggggcgtggggaggttcgggttacctttaccgtttaatttaacgcggtacgtaggttaggtaacgtactacttacttccgacgacgtacccgttcccgggagggaaccgggggtccctaactttacccgaacctacttacccgtaccgaaacggaaccgtaaacctaaacgttaccgtaaaacggaaaccctcggtttacctttacgttttacctaaacgaaaattaccgaaacgtacgtcctagggggaacggacgtaccgaagtacggaacccgcgggttaccgttaaagtttacgttaccgnggtacggacggtaaggtaacgggaccgggtccgggggttaaccccaaacggttaaccggtttaacgccggttaacgtttggggtaacgggtaaccggttcggggtaccggggggaacccctaaaacggggggttcccctaacccgggg

SEQ ID NO: 423319 - DNA, 553 bp, Homo sapiens
  misc_feature: GZ8MTXP01BFSQR.11.25.C03.1.454.CMB.2.raw
  modified_base (302)..(302): a, c, t, g, unknown or other
  modified_base (443)..(443): a, c, t, g, unknown or other
  modified_base (490)..(490): a, c, t, g, unknown or other
  modified_base (496)..(496): a, c, t, g, unknown or other
  modified_base (526)..(526): a, c, t, g, unknown or other
  modified_base (544)..(544): a, c, t, g, unknown or other
tcagcgagagataccacgaccggtgctcgatttagtagtgtagatttgggtttggggggagaggagcccagcactgggattcccaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtacagcctctggcttcacccttcattacctatggcatgcacgtcgggtccnccagactccgaggcgaggggggctgggaggtggggtggctagttatttcatatgatagggaaatgtgtacttcttattcgagtacctcgtaggaacgggtccgaattccacccgtctcccagagacaattccagcacacgntgtatctaggactaaatgaacacgccgtagagagcgtgagacgacgntagttntattacgtgtagacgaagttattaacgtangagtgacgtaacgggggngtttaacgg

SEQ ID NO: 423320 - DNA, 846 bp, Homo sapiens
  misc_feature: GZ8MTXP01APLTF.11.25.C03.1.454.CMB.2.raw
  modified_base (177)..(177): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtgggggtccctgagactctcctgtgcagcctcgtggtccaccgtcagtcacacctacagtgaggttcgggtccgccgaggcctaccggaagggggaacggggcgtggggtaggttcggggttccttttacccgtttttaatttaaccgaggtaccgttaagggtttacggggtttaaacgttaacgtaacttaacggtttacccggactaaccgggtacccgttaaccccggggttaggggaacccggggggtccctaaacgtttaccccgaaaccccttaacttacccgtaccccgaaagggaaaccggtaaaaccctaaaacccgttaaaccgttaaaacggaaacccgtaaccggttaccgttttacggtttttaaccctttaaccaaaaaagttacgggaaaacctacgtcccgttaggggaacgggtaaccggccgtaacgtacggaacccggtaccgggtaccgttaggttaactttaccggttggacggaccgggaaggaacggttacgggtcccgggggacccctaaacgggtaaacccgttacgttccggactaagggtccggaaccggttccggagggggacccgaacgggggccccgtaaccccggg

SEQ ID NO: 423321 - DNA, 761 bp, Homo sapiens
  misc_feature: GZ8MTXP01EPBI1.11.25.C03.1.454.CMB.2.raw
  modified_base (294)..(294): a, c, t, g, unknown or other
  modified_base (509)..(509): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccgaggccgtcgggggtccctgacgactctcctgtgcagcctcgtcggtcaccgtcagtcacacctanagtggaggttcgggtcccgccgaggccgtaccggagggggaacgggcgtaggacgtggtacttctttacccttttaatttacgagtcgtaggtaggtaacgtacctattacgtccgacacgtaaccgtccggtgggacggggacctacttccaacctactcctacaagaacgaactaaactacgaaaagaacctacgtctttagtttacctaaanaaactacgaaacgtcgtaccggtaaggaacggtacgaccgtaagtaccggtaaccggtaccggttaccgttaagttaacgttacggtcggtacggaacgggaaggttaaccgggtaccgggttaccccggggaaacccgttaaaacgggttaaaccggtttaccgttaccggtaacgttaacggggtaaccggggtaaccgggttccggggttaacccgggggtaaacccgggttaaaccggggtaaccccg

SEQ ID NO: 423322 - DNA, 554 bp, Homo sapiens
  misc_feature: GZ8MTXP01AFGUL.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtgtccccgaggacagacagccagaactcccctgctctggaattgaattgagagtataaatattacttgttggtaatcaacagaacgccaggccagtcccctgtattggtcatctatacagatgtagagcgcctcgaggactccgtgacgcctattctcgtcggctaaccaacgtcgtagggaaacctcgacgccactcgtacgaccatcggacgaccgggacccaggactagtggacgtgaaggctagacttagttagttgccgagggtcgtgggacaggcacgtcgacgtcgtcccgttgcgttcgtacggaccgtgggaaccgttacgttccgactgtgcgtcacggaccaacggccctaaccccg

SEQ ID NO: 423323 - DNA, 652 bp, Homo sapiens
  misc_feature: GZ8MTXP01AUMIF.11.25.C03.1.454.CMB.2.raw
  modified_base (254)..(254): a, c, t, g, unknown or other
  modified_base (296)..(296): a, c, t, g, unknown or other
  modified_base (360)..(360): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtggaggaggcctgatccagccgtgggggtccctgagctctctgtncagcctcgtggtcaccgtcagtcacactacatgagttggccncgaggctccgaggggaggcgtggagtggtcttctttattacagcagtgtagtacacttactcgnagtccgtacgtggcgggccattcacctatctacaagacgaactaaactctaaagaacctacgtcttacgtttactaacaaaatacgaaaccgcgtaccgtaaggggaacgaccgtaccgaacgtaccggaaccgtccgggttaccgttaagttacgtacgtacggtaggacggtaaggtaacgggacgggtaacccgggacccgtaaacggttaaccgttacgccggttcgtaacggtcgggtaaccggtcggggtacccggggaacccgtaaccggggttaacccgtccgg

SEQ ID NO: 423324 - DNA, 621 bp, Homo sapiens
  misc_feature: GZ8MTXP01E0C3L.11.25.C03.1.454.CMB.2.raw
  modified_base (301)..(301): a, c, t, g, unknown or other
  modified_base (371)..(371): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctcgtgggttcaccgtcagtccacacctacatgagttgggtccnccgaggcctccgaggggaaggggctggagtgggtcttctttatttacagcagtggtagtacatacttcgnagacctccgtggcggggccattcaccatcaccagacgacaactctaaagaccacgtcttgtttactacaaatcgaaacacgacctggggaacgacggccgagtcgaaccgaccgggtccgttagttacttacgtggtcggacggaagacggttacggtacggggaccccaacggtaaaccgttacgttacggccttaaggtcgggtaacggttcgggacggggacccgaaacggggttcccgtaacccgg

SEQ ID NO: 423325 - DNA, 587 bp, Homo sapiens
  misc_feature: GZ8MTXP01BF5EB.11.25.C03.1.454.CMB.2.raw
  modified_base (253)..(253): a, c, t, g, unknown or other
  modified_base (285)..(285): a, c, t, g, unknown or other
  modified_base (339)..(339): a, c, t, g, unknown or other
  modified_base (360)..(360): a, c, t, g, unknown or other
  modified_base (371)..(371): a, c, t, g, unknown or other
  modified_base (450)..(450): a, c, t, g, unknown or other
  modified_base (493)..(493): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggagcctgatccagccgtgggggtccctgagactctcctgtgcngcctcgtcgggttcaccgtcagtcacacctanatgagttggccgccaggctccgaggggagggctggagtggtcttctttattacngcagtgtagtacatacttcgnacgactccggngggcggggcctattccgacctatcctacaagacgaacaaactctaaagaactacgtcttagtttctacaaatcgaaacngcctggagacgaccgagtcgaacgccggtcgtagtacttacgngtgcggaagaggacggtcggggacccaaacgggtaacttacgcgttcgtaagtcgggccgttcggacggggaccgaacggggccgtaacccggg

SEQ ID NO: 423326 - DNA, 927 bp, Homo sapiens
  misc_feature: GZ8MTXP01BANHF.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttattttaaaaggagtccagtgtgaggtgcgtcgtggtggagtcgtggaggacggcctgactccgagccgtgggggtccctgagactctcctgtgcacgcctcgtgggtcaccgtcagtcacacctacagtggacggttcgggtccccgccgacggccgtacccggagggggaacgggggctggggaggttcgggttcttacccgttttatttacgagtaccgaggttggtaagtaacgtaacttacgttccggacgtaacggtacccgttaccccgggttagggaaccggggggtaccctaaacgtttaccccaaaccccgtaaactttcccgttaaccccgaaacggtaacggtaaaaccctaaaaccttacgttaaaaacgggaaaccctaaacccgggtttccttttacggttttttaacccttaacccgtaaaaaagttacgggaaaaaccccgtacgggttacccccgttaagggggaaaacgggttaccccgggaacccgggtaaacgttacccggaaacccgggttaacccggggtcccggtttaaggtttaaacgttttaacccgggttgggttacgggtaacccgggaaaggggaacgggttacgggggttaccccgggggaaaccccgtaaaccccggggttaaaaccgtttaacccggttaccgggttacccgtttaacgggtccggggtaacgggtttccgggtaccgggggaaccccggtaaaccgggggaaccccgttaacccgggg

SEQ ID NO: 423327 - DNA, 527 bp, Homo sapiens
  misc_feature: GZ8MTXP01ELX5T.11.25.C03.1.454.CMB.2.raw
  modified_base (297)..(297): a, c, t, g, unknown or other
  modified_base (373)..(373): a, c, t, g, unknown or other
  modified_base (503)..(503): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaaacagaagccaggccacgtccctgtattggtcatctancaagatgtgaagcgccctcgaggtactccctgacgtccgtattctcgtcggcctacccaaactcgtacgggaaccncacgcccactctcgacatcgacgcgggacccaggctagtggatcggagtctagaacttagttatggtcgaggcgtgggacagccagcactcgtccgtaatcgttcgtacgacgtggaacaggttcacgtntgaatcacgccaacgcccaacccg

SEQ ID NO: 423328 - DNA, 767 bp, Homo sapiens
  misc_feature: GZ8MTXP01D4MTO.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcctgatccagccgtgggggtccctgagactctcctgtgcagcctcgtgggtcaccgtcagtcacacctacatggaggttcgggccgccgaggcctaccggagggggaagggtcgtgggtagtgggttcttcctttatttacagactagttggtaagtacaacttcgttccgacgaagtacccgtcccgggtagggaacggggggccctaactttcccaaccctattcctacccgaagtaaacgaaccctaaaccttaccgtaaaaagaaacccgtacgttaccgttttacgtttttaccttaaaccaaaagttaccgaaacaaaccggtcccttagggggaaacgacggtaccccgtaagtaccggaacccgtaccgggtaccgttaagttaacgtttaccgtggtcgggacggtaaaggaggttacgggtaccgggggaacccctaaacgggttaaacccgtttaaccgttacggttaccgtaagggtaccggggtaacggttccggggtaccgggggaacccggtaaacggggaaccccgtaaccgggg

SEQ ID NO: 423329 - DNA, 597 bp, Homo sapiens
  misc_feature: GZ8MTXP01BSVYI.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtggggggtccccagactctcctgtgcagcctctgggttcaccgtcagtcacacctacatgagttgggtccgccaggctcgaggggagggctggagtgggtctcctttattacagcagtgtagtacatacttccgcaggacctcccggtaggacgggggtccgatttccgacctatcctccaggacacaactctaaagacacgcttacgtttacttacaaatgaaactagccctagacggacgccgatcgaccgacggtccgtgttaacttactggtagcggagaaggagttcgggggaccccaacgtaaacggttacttacgttcttaagtcggacgtcgtaggggccgaaagggcccgaacgggtaaccc

SEQ ID NO: 423330 - DNA, 605 bp, Homo sapiens
  misc_feature: GZ8MTXP01EE0CC.11.25.C03.1.454.CMB.2.raw
  modified_base (253)..(253): a, c, t, g, unknown or other
  modified_base (364)..(364): a, c, t, g, unknown or other
  modified_base (373)..(373): a, c, t, g, unknown or other
  modified_base (375)..(375): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaggagtccagtgtgaggtgcgtcgtggtggagtcgtggaggagcctgatccagccgtgggggtccctgagactctcctgtgcngcctctgggtcaccgtcagtcacacctacatgagttcggcccgccgaggctaccgaggggaacgggctggaggtggtctcctttatttacagcagtcgtagtacatatcgnacgactcgngnggggcctatcacatctcagacgacaatctaaagaacacgtctgtttacacaaatcgaaacaagccctagggacgacgaccgaagtgaaacccgcgggacccgttaggttacttacgtaggtcggcgaaggaagttacgtacgggggcccctaaacggtaaaccgtttaccgcgttaccttaagcgggtaacgttcggacgggggaccaaacggggttcccgtaacccggg

SEQ ID NO: 423331 - DNA, 620 bp, Homo sapiens
  misc_feature: GZ8MTXP01EZ2UM.11.25.C03.1.454.CMB.2.raw
  modified_base (177)..(177): a, c, t, g, unknown or other
  modified_base (267)..(267): a, c, t, g, unknown or other
  modified_base (298)..(298): a, c, t, g, unknown or other
  modified_base (304)..(304): a, c, t, g, unknown or other
  modified_base (391)..(391): a, c, t, g, unknown or other
  modified_base (454)..(454): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtcgtccgtcgtccccaggacagacagccagaactccctgctctaggtaattgaattgagataataaatattacgttgtagtatacaanagaagccagcacgtccctgtatgtcatctanacaagntgtagacggcccgcctagacggactccgaggacgtccgtatttctacgtcggaccctaacccgtaacgtccggtacggggaaacccncgaccggccctacgtcgtacgacccagtaccggacgggaccggaacccgagggtaccttaggngggtatagggacgtactagtacttagtttagttggtacgagggcggtacggacgtgaccgtagccgtacgtccgtaccgttgtcgttacggtacggaacgtacgggaaccacgggttccttaccgttgtaggaactcgaccggacccaaccggttcccgaaccccg

SEQ ID NO: 423332 - DNA, 639 bp, Homo sapiens
  misc_feature: GZ8MTXP01COA7F.11.25.C03.1.454.CMB.2.raw
  modified_base (299)..(299): a, c, t, g, unknown or other
  modified_base (350)..(350): a, c, t, g, unknown or other
  modified_base (372)..(372): a, c, t, g, unknown or other
  modified_base (468)..(468): a, c, t, g, unknown or other
  modified_base (526)..(526): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctgggtggagtctggaggaggcctgatccagccgtgggggtccctgagactctcctgtgcagcctcgtgggttcaccgtcagtcacacctacatggagttcggccnccgaggcctaccggaggggaggggctagggagtgggtcttcctttattacngcagtgtagtactatacttcgnagacctccggtgcggggtcctagttccaccgatcctaccgagacgaactaactactaaagaaccacgtactttcgtttactaacaaattcgaaacngtacccgtaggggagtacgccgaagtcgaccgacgggtcccgttagtacgtttaccgnggttcgacggaaggaggttacgggtccggggaccctaaacggtaccgttacgttacgcgtttaaggccggtaacggttcggcggggaaccgtaaaccgggcccggtaacccgg

SEQ ID NO: 423333 - DNA, 709 bp, Homo sapiens
  misc_feature: GZ8MTXP01E1N6V.11.25.C03.1.454.CMB.2.raw
  modified_base (284)..(284): a, c, t, g, unknown or other
  modified_base (399)..(399): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccaggccgtggggggtccctgacgactctcctgtgcagcctcgtcgggttcaccgtnagtcacacctacatgaggttcgggtccgccgaggcctccggagggggaacggggcgtggggagtggggtccttccgttttatttacaggtcagttggtaagtacattactccaanagcctcggtggcgggggccattccaccatctacagacacaactacaaagaccacggtcttacgttttactaaccaaatacgaaacacgtacccgtaggggaacggacggacccgtagaccgtaaccggaccgggtaccgtttacggttaacttacgttaggtacggacggaaggaacgggttacggtaccgggggttaaccccctaaacgggtaaaccgtttaccgaacccgttaccgttaacggtacgggtaacccggttcgggacccgggggaaccccgaaacgggggttaaccccgtaaccccgggg

SEQ ID NO: 423334 - DNA, 617 bp, Homo sapiens
  misc_feature: GZ8MTXP01D1Z8E.11.25.C03.1.454.CMB.2.raw
  modified_base (340)..(340): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttggtccgccaggctccgaggggaggctggagtggtctcctttatttacngcagtgtatacatacttcgcagactccggtgaacggggtccattccacctatcgtaccaagacgaacaactactaaagaacacggtacttgtttactacaaatacgaaacagtccctaggggacggtaacgcccgtaagtcgaaccgacggttccgtaagttacgttacgtgtcgcgaagaggacggtcgggggttaccccaaaggtaaaccgtttaccgacgttactaagtcgggtaaccgtcgggtacggggaccaaacggggcccgtaaccggg

SEQ ID NO: 423335 - DNA, 754 bp, Homo sapiens
  misc_feature: GZ8MTXP01ACXLC.11.25.C03.1.454.CMB.2.raw
  modified_base (236)..(236): a, c, t, g, unknown or other
  modified_base (259)..(259): a, c, t, g, unknown or other
  modified_base (299)..(299): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtgtccccaggacagacagccagactccctgctctggaattgaattgaganataaatatattgttgtatacaanagaagcaggccagtcccctgtattggtcatctatcaagtntggtagaacgccggtccctaggacgggtactcccgtgacgtccgtattcgtacgtcggacctaacccaacgttcggtacggggaaacctcgacggtcccctacgtccgttaccgaccctacgtaccggaacggggaccccgggtaaccccgagggttaccctaaggttacgggtaacgttacggggacggtaccgttaagggttaaaccttttaacggttttaaggtttacggggttaaccggaacgggggttaccgggttaaccgggggaacctacgggtaccgaaccggttacccgttaacccggttaccgggtttacccccggttttaagttcccggtttaccgggtttaccgggttaaaccggttaccgggggtaaacccgttacggttcccgttaaccgttcgttacgaaccgttaccgacggaccccgtaaccggaaccctaaaccccg

SEQ ID NO: 423336 - DNA, 690 bp, Homo sapiens
  misc_feature: GZ8MTXP01BG27B.11.25.C03.1.454.CMB.2.raw
  modified_base (260)..(260): a, c, t, g, unknown or other
  modified_base (308)..(308): a, c, t, g, unknown or other
  modified_base (386)..(386): a, c, t, g, unknown or other
  modified_base (419)..(419): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtccctgacgactctcctgtgcngcctcgtgggtcaccgtcagtccacacctacagtgaggttcgggcccnccgaggcctaccgagggggaagggctgggagttgggtcttcctttatttacagctaggtggtatacacttacttccgnagacctccgggtaggcggggcctacttccaccnttccacgaagacgaacaactcaaagaccacgtctttacgtttactacgaaaattgaaaccagtccctagggggaacgacggtacccgaagtggaacccgaaccggggttccgttaagtttaacgttacgtgggtacgacggaaagggtaacggttcgggtaccgggggttaaaccccaacgggtaaacccctttacgttaacggccgttaagggtcgggtaaccggttcggggtacgggggaccccgttaaaacggggccccgttaaccgg

SEQ ID NO: 423337 - DNA, 845 bp, Homo sapiens
  misc_feature: GZ8MTXP01DTL1P.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagtcttgggtttttccttgttgacttaattttaaaaaggagtccagtgtgaggtgcgtcgtggtggagtcgtggaggacggcctgactccgaggtccggtcggggggtccctgacgtacctctcctgtcgcacgtccttcgttcgggtccaccgtcacgtccaacacctacagtggtaggttcgggccgccgaggccgtaccggaaggggggaacgggtcgtagggtacggtttcgggttacctttaccgttttaatttaacgaggtcgtaagggttaggtaacgtaacttaactacgttccgacgtaacgtacccgttaacccggggtagggaaccgggggtaccctactttacccaaccccgttatacccgtaacccgaaaggtaaccgtaaacctaaaccgttaacgtaaaacggtaaaccctaacccggtttacctttttacggtttttaacctaaacgtaaaacgtacgaaaaaccgcggtacccgtagggggaaacggtaccggtacccggtaaacgttacgggaacccggtaaccggggttaccgtttaacgtttaagtttaccgtagggtcgaacggggtaaaggaacggttacgggtacccgggggaccctaaaacggtaacgttaaccgttcgttacgttaacggtcgggtaaccgtcgggacgggaaccgaacgggttcccgtaaccgg

SEQ ID NO: 423338 - DNA, 693 bp, Homo sapiens
  misc_feature: GZ8MTXP01ARCTZ.11.25.C03.1.454.CMB.2.raw
  modified_base (395)..(395): a, c, t, g, unknown or other
  modified_base (502)..(502): a, c, t, g, unknown or other
  modified_base (509)..(509): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtctggtggagtcgtggaggaggcctgatccagccgtgggggtccctgagtactctcctgtgcacgcctcgtgggttccaccgtcacgtccacacctacagtgaggttcgggccgccgaggcgtccggaggggaagggctgggaggttgggttccttacctttatttacgagtcgtaggtggtagtaactattactcganacgtctaccgggtgggaacggggcctaacgttccacctagttccaccgaaaggacgtaacctaaacctataaaacgacgtacgtactttagtttacctaagtaaacngaaaccngaccgtagggaacgtcgaaccgtagtaccggaaccgacgggtccgttaagttacgttaaccgtggcgcgggtaaagacgggttcggtacccggggaccctaaaggggtaaccctttacgaccggttcgttaagggcgggtcccgggttacgggcgggggaaccgaaaccgggcccgtaaccggg

SEQ ID NO: 423339 - DNA, 834 bp, Homo sapiens
  misc_feature: GZ8MTXP01EJLVJ.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtgtggtggagtcgtgggaggacggcctgactccgaggtccggtcggggggtccctgacgtacctctccgtgtcgcacgtcctcgttcgggtccaccgtcacgtccaaccacctaacagtggtacggtttcgggcccgccgacggtccgtaccggaagggggacgggtccgtgggtacggttcgggttcctttacttttaatttaaccgaggtcgtaaggttaggtaacgtactacttacgttccgacgtacgtaccgtccgggtacgggcgggggtccctaacttacccaaccctactacccgtaccgaaacgaaccgaaactaaaccgttacgaaaaacggtaacctaccgttacgttttacgtttttaacccttaaaacgtaaacgtaaccgaaaccgtacgtaccggtaacgggggaaacgggtaccggtaaccgtaacgtaccggaacccggtaccggttaccgtttaagttacgttacggtacggacggaacgggtaacgggtaacgggttaccgggtacccgggttaaacccgtaaaccggttaaacgttaccgttaccgttacgtaacgggtacgggtaaccgggtacgggaacccggggttaacccggtaaccgggttaacccgtaaccgg

SEQ ID NO: 423340 - DNA, 653 bp, Homo sapiens
  misc_feature: GZ8MTXP01BVEWW.11.25.C03.1.454.CMB.2.raw
  modified_base (286)..(286): a, c, t, g, unknown or other
  modified_base (351)..(351): a, c, t, g, unknown or other
  modified_base (360)..(360): a, c, t, g, unknown or other
  modified_base (505)..(505): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagacctctcctgtgcagcctcgtgggttcaccgtcagtcacacctacntgagttcggccgccaggctcgaggggaggctggagtggtctcctttatttacagcagtgtagtanactatccgnagcctcgtgcggggcctagttccaccgtactctaccgagacgacaacttcaaaggaaccacgtcttagtttctacaaatcgaaacagtcctagggacgacggtaccgatacggaccgtacgggtccgttagtaacgtttaccggnggtcgacggtaacggacggttacgggtacccggggttaaaccctaaaccgggttaaaccgttaccgttacggttaccgttaagggtccggggtaaccggttcggggaccgggggaaccccgtaaaccgggggttccccgtaacccggg

SEQ ID NO: 423341 - DNA, 733 bp, Homo sapiens
  misc_feature: GZ8MTXP01CIXUU.11.25.C03.1.454.CMB.2.raw
  modified_base (257)..(257): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgactccagccgtgggggtccctgagactctctgtgcngcctcgtcggtcaccgtcagtcacacctacatgagttcgggtccgccgaggccgtccggaagggggaaggggcgtggggacggttcgggttcctttaccttttagtttacgagtcgtaggtggtaagtactacttacttccgacgacgtacccgtcccgggtagggaacgggggtcctacgtttacccaaccacttccccgtaaccgacgaaacaaccgtaaacctacgtaaaagaacccgtaacgttcgtttacgttttaacctaaccgtaaaattcgaaaccaggtaccctagggggaacgacggtacccgtaagtcggaaacccgtcgggtccgttaggttaacttaccgtggtgaccgggtaagaggttaccgggtccggggaaccctaacgggtaacttaccgttacgttcgtaaggttcgggaacccggttcgggacggggaacccgaacggggttcccctaacccgggg

SEQ ID NO: 423342 - DNA, 628 bp, Homo sapiens
  misc_feature: GZ8MTXP01C762V.11.25.C03.1.454.CMB.2.raw
  modified_base (318)..(318): a, c, t, g, unknown or other
  modified_base (372)..(372): a, c, t, g, unknown or other
  modified_base (394)..(394): a, c, t, g, unknown or other
  modified_base (418)..(418): a, c, t, g, unknown or other
  modified_base (421)..(421): a, c, t, g, unknown or other
  modified_base (439)..(439): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgaggccggtcgggggtccctgacgactctcctgtgcacgtcctcgttgggtccaccgtcagtcacacctacatgtaggttcgggccnccgaggcctaccggagggggaggcgtgggaggttcggtccttacgtttattacngtcgtagtgtatacatactcgnacgacgtcgaggcgggctatcacntcncagacacactacaagacncgtacttgttactacgaaatcgaaactgcctaggggacgacgtacgagtcgaacgtccgggtcttagttacttacgtggagacgaaggagacggtccgggaaccctaaacggtaaacgtttacgacgttaccgtaaggtcgggtaaccgttcggggacggggaaccgtaacggggaacccctaaccggg

SEQ ID NO: 423343 - DNA, 638 bp, Homo sapiens
  misc_feature: GZ8MTXP01CSFZ9.11.25.C03.1.454.CMB.2.raw
  modified_base (290)..(290): a, c, t, g, unknown or other
  modified_base (462)..(462): a, c, t, g, unknown or other
  modified_base (490)..(490): a, c, t, g, unknown or other
  modified_base (537)..(537): a, c, t, g, unknown or other
  modified_base (548)..(548): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtctggtggagtcgtggaggaggcctgatccagccgtgggggtccctgagactctcctgtgcagcctcgtgggtcaccgtcagtcacacctanagtgaggttcgggtccgccgaggcctccggagggggaaggggtcgtgggtaggttgggttccttccttttatttacgagctaggtggtagtactacttacttccgcagtaccgtccggtaggcgggggcctattccaccatctaccagaacgaacctaactacaaagaaccncgtactttcgtttactacaaatgaaacngacctaggggacgacgccgagtcgacgccggtcgttagtacttacgngtggcggaagnggacggtccggggaccctaaacggtaccgttacgttcgacgttaaggcggtaaccggtcggtcgggggaccctaagggcccctaaccggg

SEQ ID NO: 423344 - DNA, 613 bp, Homo sapiens
  misc_feature: GZ8MTXP01BH5UT.11.25.C03.1.454.CMB.2.raw
  modified_base (271)..(271): a, c, t, g, unknown or other
  modified_base (350)..(350): a, c, t, g, unknown or other
  modified_base (372)..(372): a, c, t, g, unknown or other
  modified_base (404)..(404): a, c, t, g, unknown or other
  modified_base (451)..(451): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtgggggtccctgagactctcctgtgcagcctctgggtcaccgtnagtcacacctacatggagttcgggtccgccgaggcctccgagggggagggcgtggaggtcgggtcttcctttatttacngtcagtggtagtacatactcgnacgactccgtagcggggcctattccaccatcnccagacgacaactcaaagacagtcttagtttactacaaatcgaaacngtcctagggacgacgccgaagtcgaccgacgggtccgtagttacttacgtggtcgcggaagaaggaggtccgggggacccctaagggtaacccgttacgcggacgttaaggcgggtaaccgttcgggtacgggggaccccaaacgggggccctaacccgggg

SEQ ID NO: 423345 - DNA, 607 bp, Homo sapiens
  misc_feature: GZ8MTXP01E0HZY.11.25.C03.1.454.CMB.2.raw
  modified_base (294)..(294): a, c, t, g, unknown or other
  modified_base (316)..(316): a, c, t, g, unknown or other
  modified_base (567)..(567): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggagaggcctgatccagccgtgggggtccctgagactctcctgtgcagcctctgggttcaccgtcagtcacacctacatgagttgggccnccaggctccgaggggaagggcnggagtgggtctctttatttacagcagtggtagtacatacttcgctagactccgtggaacgggggtccattccaccatcctccaagacgaaacaactactaaagaaccacgtacttattttacttacaaattcgaaacgacgtcctaggggacgagacccggatcggaacctccgggccgttagtacttacgtggtagccggaagtagacgtccgggggaccctacggtaaaccggttacttcgcgttaagnggtaacgtcggcgggggttaccaacggggcctaacccggg

SEQ ID NO: 423346 - DNA, 644 bp, Homo sapiens
  misc_feature: GZ8MTXP01AJGUT.11.25.C03.1.454.CMB.2.raw
  modified_base (178)..(178): a, c, t, g, unknown or other
  modified_base (274)..(274): a, c, t, g, unknown or other
  modified_base (607)..(607): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcacgccaccctnagtcgtccgtcgtccccaggacagacagccagaacctcccctgctcgtaggtaattgaattgaagagtaattaaatattacgttgttgtatacaanagaacgcaggcctacgtccctgtacttgacatctatacgaagtatgtacggacgcccggtaccctgacgggacctccgtagacgtccgttacttctcgtcgtcctaaccgaacgtcgacgggaacctcgacgcctactctacgacctagacggacggtaccggacccgagtaccgttaagcggtaaggtcggaacgtccgttaagttaaccgttagggtttacgttccggtacggtaacggggttcggcggtaacgaccgtacgacgtcgtaccgtcgtcccgttaagtcggttacgtacggttacgtacggtaacacggttcttaccggttntaggccgtacaccgacccgtaacgaaccccgtaaccc

SEQ ID NO: 423347 - DNA, 607 bp, Homo sapiens
  misc_feature: GZ8MTXP01AQYCS.11.25.C03.1.454.CMB.2.raw
  modified_base (277)..(277): a, c, t, g, unknown or other
  modified_base (300)..(300): a, c, t, g, unknown or other
  modified_base (343)..(343): a, c, t, g, unknown or other
  modified_base (357)..(357): a, c, t, g, unknown or other
  modified_base (364)..(364): a, c, t, g, unknown or other
  modified_base (389)..(389): a, c, t, g, unknown or other
  modified_base (397)..(397): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccaggccgtggggggtccctgacgactctcctgtgcagcctcgtggtcaccgtnagtcacactacatgagttcggcncgaggctcgaggggaggctggagtcggtcttacgtttattacngctagtgtatactntactcgnagactcggtggcgggtccagtcacntctaccanacgaacaactactaaagaacctcgtacttagttctaacaaattcgaaactgaccgtagggaacgcgacgacgtaccgaacggtccggttaccgtaggttacttacggtggtcgcggaaggacggacggtcggggacccctaaggtaaccgttcttacgctaaggtcgggtaacgtcgggacggggttacctaaacggggcctaacccggg

SEQ ID NO: 423348 - DNA, 741 bp, Homo sapiens
  misc_feature: GZ8MTXP01EGLW5.11.25.C03.1.454.CMB.2.raw
  modified_base (281)..(281): a, c, t, g, unknown or other
  modified_base (309)..(309): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtcgtggtggagtcgtgggaggacggcctgactccgagccgtggggggtccctgacgtactctcctgtgcagcctcgtgggtcaccgtnacgtcacactacatgtaggttcgggccnccgaggcctaccggagggggaacgggcgtgggaggttcgggttcctttcctttatttacgagtcgtaggttggtacgtactacgttacttccgactaacgtaccgtacccgggtgggaaccgggggtcctaacgttcccaacctactcctaccgaagaacgaacctaaacgtacgtaaacgaacctacggttactttacgttttactaacgtaaagttacgaaaccgtacggtacccgtaggggaacggtaccggacccgtaagtaccggacccggtaccggttccgtttaacggttatttaccggtgtacgggacggaaggtacggacgggtacccggggaaccctaaaccggtaacggttaccttacgttacgttaaggtcgggtaaccggttcgggacggggaacccgtaacgggccccgtaacccggg

SEQ ID NO: 423349 - DNA, 640 bp, Homo sapiens
  misc_feature: GZ8MTXP01BWNLT.11.25.C03.1.454.CMB.2.raw
  modified_base (238)..(238): a, c, t, g, unknown or other
  modified_base (335)..(335): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtcgtccccaggacagacagccagactcccctgctctggaattgaattgaganataaatattacttgtggtatacaacagaagcagccacgtccctgtattgtcatctatacaagtatgtagaacgccggccctacgagggactccccgngacgccgtattctcgtcggcctaacccaacgtcgtagggaaccgcgacgccctactctacgaccactacgacgggaccgggacccgaggtaccgtagtcggagtcggaggtctacggtaactttaggtttaacgttggtaccgtacggggtcggttacggggacctaggaccgtacgcctaccgttccggtcccgttaagttcggttaccggttaccgggaccgtacggggaacccttaacgggttccgttacccgttcgttacgtaaccgttcgaccggacccgaaccggccccgtaaaccccg

SEQ ID NO: 423350 - DNA, 959 bp, Homo sapiens
  misc_feature: GZ8MTXP01BCV6V.11.25.C03.1.454.CMB.2.raw
tcagcgagagataccacgaccggtgctcgatttagtagtgtagatttggggtttgggggggagaggagcccagcactgggattccgaggtgtttccattcggtgatcagcactgaacacagaggactcaccatggtagttttggctgagtcttgggtttttccttgttgcttaattttaaaaggagtccagtgtgaggtgcgtcgtggtggagtcgtggaggacggcctgactccgacggtccggtcggggggtccctgacgtacctcctcctgtcgctacgtccgttcgttcgggttccacccgtcacgtaccaaccacctaacagttcggtacggtttccgggccccgaccgacggccgtaccgggagggggaacggggtcgtaggggtaggttcgggttccttttaccgttttaatttacgagtcgtaaggttggtaacttactacttacgtccgacgtaacggtaccgttcccgggtagggaacccgggggacccttacttaccccgaacctacgttaccccaaccggaaaggtaaacccaaaccgttaaaccctttaaaccggaaaaacgtaaacccgtaccggttttaccttttacggtttttaaacccttaaacgaaaaacgttacggaaaacccttccgggttacccgtaagggggaaaaccggggttccgggaaccccgttaaggttaccccgggaaacccggtaccccgggggtttacccgtttaaaggggtttaaaccttttccggggaggggttaaccggaaccgggggaacgggttaaaggggttaccccggggttaccccgggggttaaaccccttaaaaccggggttaaaacccggttttaccgaccgggtttaacgttaaccggggtaaaccggggtcccggggtttcgggggaacccggggggaaaccccgtaaaacccgggggttaaccccggtccccggg

SEQ ID NO: 423351 - DNA, 716 bp, Homo sapiens
  misc_feature: GZ8MTXP01BK7OO.11.25.C03.1.454.CMB.2.raw
  modified_base (541)..(541): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctctggtcaccgtcagtcacacctacagtgagttcgggccgccgaggccgtaccggagggggaacggggtcgtgggtaggttcgggttccttacctttttaagtttaacaggtacgtaaggttggtaaacgttactaacttacttccggacgtaacgtacccgtaccggggtcgggaacgggggtacccctaattacccaaccctacttacccgaccgaaagtaacgaaacaaaccttccgaaaacgaaccacgttctttagttttactacaaaatcgaaaanacgtcgtagggaacgacgccgtaagtcgaacccgtacggtccttagttaacttaccggtggtaccggaggaaggacggttacggtacccgggacccgtaaacggtaacgttaccgttcgttacgtaacgtcgggtaacccgtcggtaccggggacgaaccgggttaacccgtcgg

SEQ ID NO: 423352 - DNA, 674 bp, Homo sapiens
  misc_feature: GZ8MTXP01AMDPY.11.25.C03.1.454.CMB.2.raw
  modified_base (175)..(175): a, c, t, g, unknown or other
  modified_base (487)..(487): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtgggggtcctgagactctcctgtgcagcctcgtgggttccaccgtcagtcacacctacatgaggttcgggtcccgccgaggccgtccggaggggggaagggcgtggggtaggttcggggttccttccgtttatttacgagtctaggtggtagtactattacttccgacacgtacctccgggtgggcgggggcctacttccacctatcctacgaagacgacaaactcgtaaagacacgtcttgtttactacaaatcgaaacngcctggggaaacgcgaccgagtacggaccgtaccgggtcgttagttaaccgttgtggtacggcgaagggaacggttacgggtcccgggggaacccctaaacgggttaaacccgttacgaccgttagtaacggtacggggtccgttcggggtaccgggggaccaaacgggggttccccgtaacccggg

SEQ ID NO: 423353 - DNA, 776 bp, Homo sapiens
  misc_feature: GZ8MTXP01DEDFI.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtcgtggtggagtcgtggaggaggcctgactccgacggccggtcggggggtccctggacgaccttctccgtgtcgcacgtcccttcgtcgggttccaccgtcagtccaacacctacagtgtagttcgggtcccgccgaggcctccggaagggggaaggggcgtggggaggttcgggtcctttaccgttttaagtttacgaggctaaggttggtagtacctatacttcgcgtacgtaccgtcccgggtaggcgggggtcctacgttaccaaccgtactacctacccgaaagaaccgaaccgtaaaccttacgtaaaacggtaaacctaccgggtacttttacggttttaccttaaaccaaattaacgaaaccgtacgtaccccgttaaggggaacggtaccgggacccgtaaagtcggaacccgtaccgggtcccgtttaagttacgtttaaccgtggcgacggaaggtaggttacggtaccgggggacccctaaacgggtaccgtttaacgcccggattaacggtcgggccgggtttacggcgggggttacccgaacggggaaccccgtaaccccgggg

SEQ ID NO: 423354 - DNA, 627 bp, Homo sapiens
  misc_feature: GZ8MTXP01BMQUB.11.25.C03.1.454.CMB.2.raw
  modified_base (299)..(299): a, c, t, g, unknown or other
  modified_base (408)..(408): a, c, t, g, unknown or other
  modified_base (463)..(463): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttcgggccnccgaggcctccgaggggaaggggctgggagtcgggtcttccgtttatttacagctaggtggtagtacattacttccgcagactccggtggcggggcccattcaccatcnccagagacaactacaaagaacacgtcttagttttacttaacaaaattgaaaaccncgtaccagggaagacgccgaagtcgacgaccggtcgtagtacttacgtggtagcgaaggaggacgggtccggggaccccgtaaacggtaaccgttacgttaccgcgttaaggtcgggtaaccggtcgggaccggggaacccgtaaacggggaaccccgtaacgg

SEQ ID NO: 423355 - DNA, 684 bp, Homo sapiens
  misc_feature: GZ8MTXP01AU2FL.11.25.C03.1.454.CMB.2.raw
  modified_base (180)..(180): a, c, t, g, unknown or other
  modified_base (264)..(264): a, c, t, g, unknown or other
  modified_base (316)..(316): a, c, t, g, unknown or other
  modified_base (543)..(543): a, c, t, g, unknown or other
  modified_base (581)..(581): a, c, t, g, unknown or other
  modified_base (597)..(597): a, c, t, g, unknown or other
  modified_base (603)..(603): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagtcttgggtttttccttgttgcttaattttaaaaggngtccagtgtgaggtgcgtcgtggtggagtcgtggaggagcctgactccgaggccggtcgggggtccctgagactctcctgtgcncgcctcgtcgggttcaccgtcacgtcacacctacagtggacgttcgggcccnccgaggcctaccggaagggggaaggggcgtgggacggttcgggttcctttacttttatttaacacggtacgtaggtacgtaacgtactacgttccgtcgacgtaacgtccgtacgggacgggccggtaccttacaccctacctcgtaccacgaacaacgtaacctaaacgttaaacgaaacaacccgttctttacgttttactttaacaaacgaaacgtacgaaacncgtaccgaagtacggacgagtacgacgacgtcccggtnttacgtactggtacgngaaggngtacgttcgggcccttaccgaaagttacccgttagcgttagtcgggacgtcggacgggcggacgaaccgttcgtaaccccg

SEQ ID NO: 423356 - DNA, 623 bp, Homo sapiens
  misc_feature: GZ8MTXP01A0VLU.11.25.C03.1.454.CMB.2.raw
  modified_base (175)..(175): a, c, t, g, unknown or other
  modified_base (297)..(297): a, c, t, g, unknown or other
  modified_base (338)..(338): a, c, t, g, unknown or other
  modified_base (371)..(371): a, c, t, g, unknown or other
  modified_base (423)..(423): a, c, t, g, unknown or other
  modified_base (427)..(427): a, c, t, g, unknown or other
  modified_base (452)..(452): a, c, t, g, unknown or other
  modified_base (516)..(516): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtgggggtccctgagactctcctgtgcacgcctcgtggttcaccgtcagtcacactacatgagttcgggccncgaggctcgaggggagggctggagtggtcttctttattacngctagtgtagtacactacttcgcagactccggnggaacggggcctagttccacctattccacagacgacaactactaacgaaccncgtnttacgtttctaacaaattcgaaacngcccgtagggaacgtacggccaaagtcgacgacgggtccgttagtactacgtgtacgcggaagnggttacggtccgggggacccctaaacgggtaacctttacggaccgacgttaaggtacgggtaaccgttcggggacggggacccgaaacggggttcccgtaacccggg

SEQ ID NO: 423357 - DNA, 607 bp, Homo sapiens
  misc_feature: GZ8MTXP01AXPRT.11.25.C03.1.454.CMB.2.raw
  modified_base (175)..(175): a, c, t, g, unknown or other
  modified_base (191)..(191): a, c, t, g, unknown or other
  modified_base (358)..(358): a, c, t, g, unknown or other
  modified_base (362)..(363): a, c, t, g, unknown or other
  modified_base (370)..(370): a, c, t, g, unknown or other
  modified_base (372)..(372): a, c, t, g, unknown or other
  modified_base (384)..(384): a, c, t, g, unknown or other
  modified_base (405)..(405): a, c, t, g, unknown or other
  modified_base (462)..(462): a, c, t, g, unknown or other
tcagcgagagataccacgaccggtgctcgatttagtagtgtagatttgggtttggggaggaggagcccagcactgggattccgaggtgtttccattcggtgatcagcactgaacacagaggactcaccatggagttttggctgagctgggttttcctgttgctattttaaaaggngtccagtgtgaggtgngtctggtggagtcgtggaggacggcctgatccaggccgtggggggtccctgagactctcctgtgcagcctcgtgggttcaccgtcagtcacacctacatcgagttcggtccgcgtaggctccgaggggaagggctggagtggtctcttattcagcagtgagtacatntcgnngactcgngnggcatcacatcncagagacaactctaaagaacncgtacttgtttactacgtaaattcgaaacaggtccctaggggaacgtacggccgtanacggaccgtacgggtccttaggttacttaccgtggtagcggaaggacgaggtaccgggggaccctaaacgggtaacgttaccgttacgccgttaagtacgggtaacgttcggtcgggggacccaaacgggggcccctaacccggg

SEQ ID NO: 423358 - DNA, 905 bp, Homo sapiens
  misc_feature: GZ8MTXP01BT2I9.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtcttgggtttttccttgttgtacttaagttttaaaaaggagtccagtgtgaggtgcgtcgtggtggagtcgtggaggacggcctgactccgaggtcccggttcggggggtccctggacgtaccttcctccgtgtcgcgacgtccgttcgttcgggtccaccgtcacgtccacacctacagtggtacggttcgggtcccgaccgacggtccgtaccgggaagggggtaacggggtcgtagggtacggtttcgggttaccttttaccgttttaagtttacgagtacgtaggttacggttaagtaactacgttacgttccgacgtaacgtaccgttaccgggtacgggtaacggggtacccgtaccgttacccgaacccgtacgttacccgtacgaaacgggtaccaaaaccctaaaccttaacgtaaaaccggaaaccctcggtttaccttttacggttttaaacctaaacgaaaagttaccgaaacctacgggtcccgttaagggggaaacgttacggacccgttaagtaacccggaaccccggtacggggttacccgtttaaagttaccgttttacggacgggttccggaacgggtaaacgggtaaacggttccgggggttaaaccccgggggacccctaaaaaacggggtttaacccttaaccccggttacggttaccgtttaaacgggtccggggtaaacccggttcgggggaaccccgggggaaaccgtaaaccggggttaacccccgttaaccggg

SEQ ID NO: 423359 - DNA, 600 bp, Homo sapiens
  misc_feature: GZ8MTXP01AYKT1.11.25.C03.1.454.CMB.2.raw
  modified_base (244)..(244): a, c, t, g, unknown or other
  modified_base (271)..(271): a, c, t, g, unknown or other
  modified_base (298)..(298): a, c, t, g, unknown or other
  modified_base (359)..(359): a, c, t, g, unknown or other
  modified_base (432)..(432): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactntcctgtgcagcctctgggttcaccgtnagtcacacctacatgacgttcggtccncgagctccgagggagggctggagtggtctctttattacagcagtgtagtactatatccganacgtcgtcggcggcggactactccacactcacagacacactacaagacacgtcttagttacacaagtacaacncgtcgtagggacgtagccgaatcgaccgtacggtccgttagttacgttcgtggtacgacgtaagacggttcgggtacccggggttacccaaaccggttaacgttaccgttccgttacgtaacggtcggtccgttcggggaccgggacccgaacgggttcccgtaacgg

SEQ ID NO: 423360 - DNA, 848 bp, Homo sapiens
  misc_feature: GZ8MTXP01ACZF0.11.25.C03.1.454.CMB.2.raw
  modified_base (319)..(319): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgtacttaattttaaaaggagtccagtgtgaggtgcgtcgtggtggagtcgtggaggagcctgactccgaggccggtcggggggtccctggacgtacctctccgtgtcgcgtacgtcctcggttcgggttccaccggttcacgtccaacaccctanagtggtaggttcgggtcccgcgacggtccgtaccggaagggggaacggggtcgtaggggtacggttcgggttacctttaccgttttaatttaaccgaggtaccgtagggtttacggtaacgttaactaaacgttccgttccgacgtacggaaccgttccccgggtaggggaacccgggggtccctaaacgtttcccaaaccctgttccctacgaaacgacgtaaacctaaacctacgtaaacgaaaccgtcgtaccctttaggttttaccctaaagaaagttacgaaaccgtcgtacccgagggaacggacgacccggttaagtaccggaacccggtacgggtacccgtttaggtttaacgtttaaccgggtgggtaccgggaacgggtaacggtaacggggttacccgggttaacccggggaaaccccgttaaacgggttaacccggttaccgttacggttacggttaacggtacgggtaaccggtacggggtaccggggaacccgtaaccgggaacccgtaacccgg

SEQ ID NO: 423361 - DNA, 591 bp, Homo sapiens
  misc_feature: GZ8MTXP01A7FCQ.11.25.C03.1.454.CMB.2.raw
  modified_base (177)..(177): a, c, t, g, unknown or other
  modified_base (244)..(244): a, c, t, g, unknown or other
  modified_base (258)..(258): a, c, t, g, unknown or other
  modified_base (278)..(278): a, c, t, g, unknown or other
  modified_base (288)..(288): a, c, t, g, unknown or other
  modified_base (293)..(293): a, c, t, g, unknown or other
  modified_base (374)..(374): a, c, t, g, unknown or other
  modified_base (426)..(426): a, c, t, g, unknown or other
  modified_base (554)..(554): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtgtccgtgtccccaggacagacagccagaactcccctgctctggaattgaatgagagtataaatntattgtgtatcaanagagcaggccagtccctgtntgtcatctancaagntgtagacgccgccctgacggtctcccgaggacgtccgtacttcgtcgtcggccctaaacctaacgtcggtacgggaacccncaacgcctacgtctacgaccagtacgacgggccggacccgaggtacctaggngagcgagggcttagtaacttaggttacgttcggtacgtaggggtccggtaggacgacgtacgagtccgtacgtccgtccgttaagtcgttacggtacggacgtacgggacttaacggttccttacgtntacggcgtccgacgttacccgaacgttccctaacccg

SEQ ID NO: 423362 - DNA, 579 bp, Homo sapiens
  misc_feature: GZ8MTXP01EMKE4.11.25.C03.1.454.CMB.2.raw
  modified_base (303)..(303): a, c, t, g, unknown or other
  modified_base (310)..(310): a, c, t, g, unknown or other
  modified_base (363)..(363): a, c, t, g, unknown or other
  modified_base (370)..(370): a, c, t, g, unknown or other
  modified_base (382)..(382): a, c, t, g, unknown or other
  modified_base (385)..(385): a, c, t, g, unknown or other
  modified_base (388)..(388): a, c, t, g, unknown or other
  modified_base (390)..(390): a, c, t, g, unknown or other
  modified_base (397)..(397): a, c, t, g, unknown or other
  modified_base (405)..(405): a, c, t, g, unknown or other
  modified_base (417)..(417): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccagccgtgggggtccctgagactctcctgtgcagcctcgtggtcaccgtcagtcacacctacatgagttcgggccnccaggcncgagggagggctggagtggtcttctttattacagctagtggtatacatatcgnagctcgngcgggcatcacntcncananacaatanaacgaacngcttgtttcaanaaatacgaaacagtccgtagggaacgtacgaccgtaagtcgaaccgacggtccgttagttattacgtgcgagaagacgaggtccgggaccctaaaggtaacgttcacgttacgtaagcggtaaccgtcggtaacggggaccgaaacgggaaccgtaacccgg

SEQ ID NO: 423363 - DNA, 706 bp, Homo sapiens
  misc_feature: GZ8MTXP01B7MQC.11.25.C03.1.454.CMB.2.raw
  modified_base (255)..(255): a, c, t, g, unknown or other
  modified_base (271)..(271): a, c, t, g, unknown or other
  modified_base (283)..(283): a, c, t, g, unknown or other
  modified_base (296)..(296): a, c, t, g, unknown or other
  modified_base (303)..(303): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtggtttcgtgtagctattaaagagtcagtgtgaggtgcgtgtggtggagtcgtggaggacggcctgactccaggtccgtgggggtaccctgacgtctctctgtgcanctcgtaggtcaccgtnagtcacacctanatgagttcggccncgagtcncggagggaggctggagtcggttctacgtttattacgagtcgtaggtggtatactaacgttcgttaccgagaacgtccgttccgggaggaacgggggtcctaaacgtttcccacctaacgttcctacgggaaacgtaacgaacctaaaccttaacggaaacgaaaccgtcgttaaccgttttacgtttaactaacgaaactaacgtaacgtacgtacgtacggacgtacgtacgtacgtacgtaccgtaccggtacgttacgttacgttacgtacggtacggtacggtaacggtacggttacgggtaccggttaaccggtaaaccgttaacgttacgttacgttacgtaacggtacggtaacggtacgggtacgggttaccggtaaccggttaaccggtaaccg

SEQ ID NO: 423364 - DNA, 669 bp, Homo sapiens
  misc_feature: GZ8MTXP01D179Y.11.25.C03.1.454.CMB.2.raw
  modified_base (296)..(296): a, c, t, g, unknown or other
  modified_base (310)..(310): a, c, t, g, unknown or other
  modified_base (352)..(352): a, c, t, g, unknown or other
  modified_base (451)..(451): a, c, t, g, unknown or other
  modified_base (475)..(475): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaatttaaaaggagtccagtgtgaggtgcgtcgtggtggagtcgtgggaggaggcctgactccgaggccgtggggggtccctgacgacctctcctgtgcagcctcgtcgggtcaccgtcagtcacacctanatggagttcggccncaggctcggaggggagggctggagtggtcttctttattacgngtctagtggtacgtactactacttcgacgtagacctccgggtggaacgggggcctattacccaacctactcctacgaagacaactaaactacgtaaaanactgttctctttacgttactaaanaaacgtacgaaactcgaccggtagacggacgtaccgtagtaccggaacgtaccgggtacgttaagtacgttacgtggaggaacggaaggacggtaccgggttaccgggaaaccctaaacggttaaacccgttcgaccgtaacgtaggtaaccgggtacgggtacgggaccgggtaaccggaaccggggtaaccc

SEQ ID NO: 423365 - DNA, 632 bp, Homo sapiens
  misc_feature: GZ8MTXP01ELQJI.11.25.C03.1.454.CMB.2.raw
  modified_base (281)..(281): a, c, t, g, unknown or other
  modified_base (293)..(293): a, c, t, g, unknown or other
  modified_base (305)..(305): a, c, t, g, unknown or other
  modified_base (372)..(372): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtcgtgggtggagtctgggaggaggcctgatccgagccgtgggggtccctgacgtactctcctgtgcagcctcgtgggtcaccgtnagtcacactacntgagttcggccncaggctcggaggggaggctggagtggtcttctttattacgagtcgagtggtatactactactccganacgtaccgtccggtaggcgggggcctactacccacctatcctaccgaagagactaaaccgtacaaacgaaccacggttcttagtttacctaacgaaatcgaaacacgcctagggacgacgccgagtccgacgtacgggtccttagttactagtgtggcggaagtacgacgggtaccgggaccctaaacgggtaaccttacgttcgacgtaaggtcgggaacgttcgggacggggacccgtaacgggttcccgtaacccgg

SEQ ID NO: 423366 - DNA, 873 bp, Homo sapiens
  misc_feature: GZ8MTXP01B9Z1F.11.25.C03.1.454.CMB.2.raw
  modified_base (178)..(178): a, c, t, g, unknown or other
  modified_base (320)..(320): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggngtccagtgtgaggtgcgtcgtggtggagtcgtggaggaggcctgactccgacggcccggttcggggggtccctaggacgtaccttctccgtggtcgaccacgtcccttcgttcgggttccacccgtcacgtccaccacctanagtgtagttcgggtcccgccgacggccgtaccggaagggggaacggggtcgtgggtacggttcgggttcctttaccgttttaatttacgacgtacgtaggttaggtaacgtactaaccttacgttccgacgtaacgtaccgtccgggttagggaaccgggggtcccgtaacgtttacccaacccgtacttacccgtaacccgaaagaaaccgtaactaaacccttacgtaaaacgaaaccgtacccgttacgttttacgttttaccttaaacgaaacgttaacgaaacgtacgtaccccgtttaagggggaacgtaccggtacccggaaagtttcccggaaacccggtacccggggttaccgttaaggttttaaccgttaaccggttgggtacggacgggaaacggagggttaaccgggttacccgggggaaacccctaaaacgggtttaaccggttaaccgttaccgggttacgttaagggtaccggggtaacccggtttacggggaccgggggaacccctaaaccgggggttaaccccgttaaccccgggg

SEQ ID NO: 423367 - DNA, 624 bp, Homo sapiens
  misc_feature: GZ8MTXP01EFZA9.11.25.C03.1.454.CMB.2.raw
  modified_base (180)..(180): a, c, t, g, unknown or other
  modified_base (296)..(296): a, c, t, g, unknown or other
  modified_base (309)..(309): a, c, t, g, unknown or other
  modified_base (353)..(353): a, c, t, g, unknown or other
  modified_base (355)..(355): a, c, t, g, unknown or other
  modified_base (371)..(371): a, c, t, g, unknown or other
  modified_base (381)..(381): a, c, t, g, unknown or other
  modified_base (384)..(384): a, c, t, g, unknown or other
  modified_base (505)..(505): a, c, t, g, unknown or other
  modified_base (511)..(511): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagtcttgggtttttccttgttgcttaattttaaaaggngtccagtgtgaggtgcgtcgtggtggagtcgtggaggaggcctgactccgaggccgtgggggtccctgagactctcctgtgcagcctcgtcgggttcaccgtcacgtcacacctanatggagtcggccncgaggctacggaggggacggcgtggagtggtcttctttattacngnagtgtatacatctcgnacgacgtcgnggngggcctatccactatcacaagacactaaactacaaacgaactacgtcttacgtttacaacaaatcgaaacacgccgtaggacgacgaccgagtacgaccgtacgtccgtagttacttacgnggtcgnggtaagaacggttacggtacccgggggaccctaaacgggttaacgttaccgttacgttacgtaaggtcgggaacgttcgggacgggggaacccgtaacgggcccgtaaccggg

SEQ ID NO: 423368 - DNA, 584 bp, Homo sapiens
  misc_feature: GZ8MTXP01A448N.11.25.C03.1.454.CMB.2.raw
  modified_base (301)..(301): a, c, t, g, unknown or other
  modified_base (320)..(320): a, c, t, g, unknown or other
  modified_base (341)..(341): a, c, t, g, unknown or other
  modified_base (344)..(344): a, c, t, g, unknown or other
  modified_base (360)..(360): a, c, t, g, unknown or other
  modified_base (368)..(368): a, c, t, g, unknown or other
  modified_base (370)..(370): a, c, t, g, unknown or other
  modified_base (391)..(391): a, c, t, g, unknown or other
  modified_base (393)..(393): a, c, t, g, unknown or other
  modified_base (408)..(408): a, c, t, g, unknown or other
  modified_base (435)..(435): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctggaggaggcctgactccaggccgtgggggtccctgagacctctcctgtgcagcctcgtggtccaccgtcagtcacacctacatgagttcggccncaggctacgaggggaggcnggagtggtcttctttattacngcngtgtagtcatactcgnagctccgngngggcctatcaccatcaccgananaccaactcaagaacncgtcttgtttactacaaatcgaaaccnacgtaggacgacgaccgagtacgacgtcggtcgttagtaacgttcgtggtacgacggaagacggttacgggtaccggggaccctaaacggttaacttacgcgttctaaggtcgggtaacgtcggacggggaccgaacgggttccgtccg

SEQ ID NO: 423369 - DNA, 826 bp, Homo sapiens
  misc_feature: GZ8MTXP01B7V8X.11.25.C03.1.454.CMB.2.raw
tcagcgagagataccacgaccggtgctcgatttagtagtgtagatttggggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggacggcctgatccgaggtccgtggggggtccctgacgacttctcctgtgcagcctcgtcgggttcaccgtcagtccacacctacatggaggttcgggtcccgccgacggcctacccggagggggaacggggtcgtggggaggttcgggttcttaccttttatttacgaggtctaggttcggtaagtacctaagttaccgtttccgacgtacgtacccgttcccgggtagggaacggggggtccccgtaatttaccccaacccctacttcccgtacccgaaagggaacctaaacctaaaacccgttacgtaaaacgtaaaaccctacccggttaccgttttacgtttttaaccccttaacggtaaaaacttacgggaaaacctacggtaccccgttaagggggaacgggtaccgggaacccgtaacgttacgggaaacccgtacccgggggttacgtttacggttaacgtttaaccgtgggtaaccggcgggaagggtacgttagggtccccgggggaaccctaaaccggttaacgtttaccgttaccggttcgttaaggtcgggtccggttacgggacggggcccgtaaaccggggcccgtaaccccggg

SEQ ID NO: 423370 - DNA, 739 bp, Homo sapiens
  misc_feature: GZ8MTXP01D6MNP.11.25.C03.1.454.CMB.2.raw
  modified_base (177)..(177): a, c, t, g, unknown or other
  modified_base (265)..(265): a, c, t, g, unknown or other
  modified_base (277)..(277): a, c, t, g, unknown or other
  modified_base (293)..(293): a, c, t, g, unknown or other
  modified_base (313)..(313): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatgtagttttggctgagtctgggttttccttgttgctaattttaaaaggngtccagtgtgaggtgcgtcgtggtggagtcgtggaggaggcctgactccgaggccggtcggggggtccctgacgtactctcctgtgcngcctcgtggtcnccgtcagtcacactanagtggtaggttcgggtcccncgaggcctaccggaggggacgggctgggagttcggtcttcctttagtttacagtacgtaggttaggtagtactacttaccgttaccgactaacggtaccgtacccgggtagggccgggggtacctaacgttacccaccgtactccctacgaacgacgaacctaaacttacaaacgtaaacctcgttacgtttacgtttacctaaacaaatacggaaactacggtacccgtagggaaacggaccggtaaccgtacgttaccggaacccggtaccggggttaccggtttaaagtttaaccgttaccggtggtcgggaaccggtaaggtacgggacgggtacccgggaaccctaaacggtaacgttaccgttacgttacgtaacgtacggccgttcggggaccgggaacgtaacgggcccgtaacccgg

SEQ ID NO: 423371 - DNA, 666 bp, Homo sapiens
  misc_feature: GZ8MTXP01A30G9.11.25.C03.1.454.CMB.2.raw
  modified_base (175)..(175): a, c, t, g, unknown or other
  modified_base (299)..(299): a, c, t, g, unknown or other
  modified_base (388)..(388): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctatttaaaaggngtccagtgtgaggtgcgtctggtggagtctggaggaggcctgatccagccgtgggggtccctgagactctcctgtgcagcctcgtcggtcaccgtcagtcacacctacagtgaggttcgggccnccgaggcctaccggagggggaacggggcgtgggaggttcgggttcttacctttaatttacagctaggtaggtagtactatacttccganacgtaccgtccggtgggaacggggtcctacttccaacctatccctcaaagacgaaccaactactaaacgaacacgtacttcgtttactaacgaaattgaaactacgaccgtaggaacgacgaccgagtacgacgaccgggtcgtagttaattccgtgtgacggaagacggttacggtccgggggaccctaaacggttaaaccgttacgttaccgacgtaacggtacgggtaacggtccgggtagggggaccccgtaaacggggaacccgtaacccggg

SEQ ID NO: 423372 - DNA, 823 bp, Homo sapiens
  misc_feature: GZ8MTXP01A9APL.11.25.C03.1.454.CMB.2.raw
  modified_base (259)..(259): a, c, t, g, unknown or other
  modified_base (277)..(277): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtggaggaggcctgatccagccgtggggggtccctgacgactctctgtgcncgcctcgtggtcaccgtnacgtcacacctacatggtacgttcgggtccgccgaggcctaccggagggggaacggggtcgtaggggtaggttcgggttaccttttaccttttaacgtttaacgacggtcgttaggttacggttaagtacctaattacggtttaccgacgtaacggtacccgttaccccggggtagggaacggggggtccctaacgtttacccaaccctacttacccgtacccgaaaggtaaccaacctaaacctacgtaaaacgaaacccgtacgttacgtttacgttttacctaagtaaaacttcgaaaccgtagtccgttaacgggaagaccggtaccgtagtcggtaacccgtacggtacccggttagttaacgttaccgtggtacgggaacggaacgggtacggttaacggggccccgggggttaaaccccgtaaacggttaaccggtttaacccggccggttacggttaacccgggtaggggtaacccgggttcggggtacccggggggaaacccccggaacgggggttaacccccggttaacccggggg

SEQ ID NO: 423373 - DNA, 769 bp, Homo sapiens
  misc_feature: GZ8MTXP01B72B2.11.25.C03.1.454.CMB.2.raw
  modified_base (185)..(185): a, c, t, g, unknown or other
  modified_base (282)..(282): a, c, t, g, unknown or other
  modified_base (348)..(348): a, c, t, g, unknown or other
  modified_base (494)..(494): a, c, t, g, unknown or other
  modified_base (624)..(624): a, c, t, g, unknown or other
tcagcgagagataccacgaccggtgctcgatttagtagtgtagatttggggtttgggggggagaggagcccagcactgggattccgaggtgtttccattcggtgatcagcactgaacacagaggactcaccatggtagttttggctgagtcttgggttttccttgttgacttaattttaaaaggntccagtgtgaggtgcgtcgtggtggagtcgtgggagggacggcctgactccgacggtccgggttcgggggtccctggaacgtccttcctccgtggcnccgacgtccgttcggttcgggtccaccgtcacgtaccacacctacagttggtacggttcgggcccncggacggtccgtacggaggggggaacgggtgtggggtaggttccggttactttaccgttttaagttacgaggtctaggttaggtactacctattaccgttcgacgagtacccggtccgggtaggcggggtaccacgttaccacctntccacaagaacactaactacgtaacgaactcgttcgtttacttactaaacaacgtacgacgtagtccgagggaacgccgtaaccctagtacggaaacccgtcccggggttattacgttacgttaccgggnggtacgggaaggaacggtaacgggttaccggggtaccggttaaaccctaaaacgggttccttaaccggttgttaccggttaaggggccgggttaaccggtacgggggtaaccgggttacccgtaaccggggttaaccccgtcggg

SEQ ID NO: 423374 - DNA, 647 bp, Homo sapiens
  misc_feature: GZ8MTXP01EONEW.11.25.C03.1.454.CMB.2.raw
  modified_base (241)..(241): a, c, t, g, unknown or other
  modified_base (297)..(297): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcacgccaccctcagtcgtcccgtcgtccccaggacagacagccagactcccctgctctaggaattgaattgaganaataaatattactgttagatcaacagaacgcagccacgtccctgtatgtcatctanacaagtatgtagaacgcccggcctacgaggtactcccgtagacgtccgtatttccgtgtcggtacccttaacccgaaccgttcggtaacggggaaaccgtccgaacggtcccctaacgtccgtacgaacccctagtaccggaacgggcccgggtaacccgaagggtaccttaggtaggtatggaacggtctagtaacgtttagttagttggtacgacgggtcggtcgggacacggactacgcctacgtcgtccccgttaagtccgttacggttacggaccgtacggggaacccagggttcccacggttctaggaacgtccaaccggaccctaaccggaaccctaaccccg

SEQ ID NO: 423375 - DNA, 900 bp, Homo sapiens
  misc_feature: GZ8MTXP01AUWMV.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggtttttccttgttgcttaatttaaaaggagtccagtgtgaggtgcgtctggtggagtcgtggaggaggcctgactccgacggccggtcggggggtccctgacgtaccgttctccgtgtgccgacgtcccgttcgttcgggttccaccgtcacgtaccaccacctaacgagtcggtacggttccgggtcccgaccgacggcccgtaccggaggggggaacggggtcgtagggacggtttcgggttacctttaccgttttaagtttaacgacgtacgtaggtaggttaagtacctaacgttaccgttaccgacgtacgtaaccggttccccgggtaggggaacgggggtccctaaaccgttaccaaacccgtctttacccgacgaaacgtaaccgtaaacctaaaaccgtaacgtaaaacggaacccttaaccggttcctttacgtttttaaccctaaactaaaacgttacgaaaaccgtccggtacccgttagggggtaaaccggaccggggtaaccgtaacgttaaccgggaaacccgttaacccgggggttcccgtttaaagtttaacccgttacgggttacggtacggggacggtaaacggtccggggttaaaacggggttccccggggaaaccccgttaaaacggttaaaccgtttacccggacggttaccggttaaaggttccggggtaaccggtccgggggtaaccggggaaccccggtaacggggttaacccccgtaaccggg

SEQ ID NO: 423376 - DNA, 809 bp, Homo sapiens
  misc_feature: GZ8MTXP01CCMOL.11.25.C03.1.454.CMB.2.raw
  modified_base (183)..(183): a, c, t, g, unknown or other
  modified_base (412)..(412): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggtagttttggctgagtcttgggttttccttgttgcttaattttaaaaggngtccagtgtgaggtgcgtcgtggtggagtcgtgggaggacggcctgactccgacggtccggtcggggggtccctgacgaccttcctccgtgtcgccacgtccttcgttcgggttccaccgtcacgtccacacctacagtggtaggttcgggtcccgccgacggcgtaccggaaagggggaggggtcgtggggtacggttcgggttacctttaccgttttagtttaacgnggtaccgtaggttggttaagtactaacgttacgttaccgcgtacgtacccgttccgggtagggaacgggggtccctaacgttacccaccgtattacccgtacgaaagtacgtaaaccttaaaacccgttagtaaaacgaccgtacgttaccttttaggtttaaccctaccgaaaagttcgaaacgcgtaccctaggggaacggtacgaccccgtaaggacgaacccgtccggggtactttacggtaaacttcgtacggtcgaacgggtaaccgaaagggttccgggtaacccccgggacgtaaaccggttaccgttttaacccgcgttacgttaacggtcggggtaaccgtttccgggacggggaacccgtaaaccgggttaacccgtaaccccggg

SEQ ID NO: 423377 - DNA, 619 bp, Homo sapiens
  misc_feature: GZ8MTXP01AP6EL.11.25.C03.1.454.CMB.2.raw
  modified_base (177)..(177): a, c, t, g, unknown or other
  modified_base (300)..(300): a, c, t, g, unknown or other
  modified_base (368)..(368): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttatttaaaaggngtccagtgtgaggtgcgtcgtggtggagtcgtggaggaggcctgatccagccgtgggggtccctgagactctcctgtgcagcctcgtgggttcaccgtcagtcacactacatgagttgggccncaggctccgaggggaaggcgtggagtgggtcttcctttatttacagcgagtggtagtacatacttcgnacgtactccggtgcggggcctacttcaccactctaccacgagacaactacaaagaacctagcttgtttactacaaagtgaaacacgtacctgggagacggacccgatacgaccgtacggccgttagttaacttacctgggtagcggtaacggagttaacggtccgggggaaccctaacgggtaacgttaccgttacgacgttaacgacgggtccggtacgtacggggacccgtaaggggccctaacccggg

SEQ ID NO: 423378 - DNA, 585 bp, Homo sapiens
  misc_feature: GZ8MTXP01CYKHZ.11.25.C03.1.454.CMB.2.raw
  modified_base (212)..(212): a, c, t, g, unknown or other
  modified_base (281)..(281): a, c, t, g, unknown or other
  modified_base (295)..(295): a, c, t, g, unknown or other
  modified_base (309)..(309): a, c, t, g, unknown or other
  modified_base (332)..(332): a, c, t, g, unknown or other
  modified_base (379)..(379): a, c, t, g, unknown or other
  modified_base (390)..(390): a, c, t, g, unknown or other
  modified_base (404)..(404): a, c, t, g, unknown or other
  modified_base (422)..(422): a, c, t, g, unknown or other
  modified_base (504)..(504): a, c, t, g, unknown or other
tcagcgagagataccacgaccggtgctcgatttagtagtgtagatttggggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggnggaggcctgatccagccgtgggggtccctgagactctcctgtcgcagcctacgtcgggttcaacccgtnacgtacacacctanatggagttgggccncaggctaccgaggggaagggtcnggtagtgggtccttctttaattacagcagtagtagtacatatccganacgacgtacgnggcggctatacacntcacgacgacacaactanaaacgaacacgtctttgttactaacgaaatacaacgacgacgacggagacgacgagacgacgacggtacgtactatgtgcgngaagagaggtacggaccgtaacgtaacgttacgttcgttacgtaagtacggcggtcggacgggacggaacggaaccgaacg

SEQ ID NO: 423379 - DNA, 562 bp, Homo sapiens
  misc_feature: GZ8MTXP02JBMTI.11.25.C03.1.454.CMB.2.raw
  modified_base (248)..(248): a, c, t, g, unknown or other
  modified_base (380)..(380): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtgtagcgtatttaaagagtcagtgtgaggtgcgtctggtggagtctggaggaggcctgatccagcctggggggtccctgagactctcctgtgcngctcgtggtcacgtcagtcacacctacatgagttcggtccgccgacggcgtccgaggggaggggcgtggtaggtggtcgttctttatttactagcgtagtaggtagtactactactcgcacgacgtcgtggnggggcgactcacactctcacgacgacaactactaacgaacacgtcttctttacttactaatacgaacacgacgtagagagcgagtagacgacgacgtgtacttacgtgtgacgagagaggcgggaccgacgaacgtacgtacgacgtaagtacggtacggtcgacggaccggacggacgacg

SEQ ID NO: 423380 - DNA, 543 bp, Homo sapiens
  misc_feature: GZ8MTXP02JWWPO.11.25.C03.1.454.CMB.2.raw
  modified_base (375)..(375): a, c, t, g, unknown or other
  modified_base (468)..(468): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtgggtctcctttattacagcagtggtagtacatattcctcagactccgtgnggggccattcacatctcagagacaactctaaagacacgcttgtttctacaaatgaaacagcctgagagccgatgacgacggcctgtattacgngtgcgagagagtcggggacccaacgtaacgttactacgctaagtcggacgtcgtggggaccaacggggaccacgg

SEQ ID NO: 423381 - DNA, 544 bp, Homo sapiens
  misc_feature: GZ8MTXP02GALBG.11.25.C03.1.454.CMB.2.raw
  modified_base (362)..(362): a, c, t, g, unknown or other
  modified_base (390)..(390): a, c, t, g, unknown or other
  modified_base (523)..(523): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggccgccaggctccgaggggagggctggagtggtctcctttattacagcagtgtagtacatatccgnagactccgtgcggggccattcaccatcnccagagacaactctaaagaacacgctgtttacttacaaatgaacagcctagagagccgatgaccacggcgtgtacttacgtgtgcgagagagtcggggcccaacgaacgttacacgactaagtcggacgtcgnggggaccaacggggcctacgg

SEQ ID NO: 423382 - DNA, 521 bp, Homo sapiens
  misc_feature: GZ8MTXP02GEFC1.11.25.C03.1.454.CMB.2.raw
  modified_base (356)..(356): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggatccctgagccgattctctggctccaatctgggaacncagccactctgaccatcagccgggacccaggctatggatgaggctagactattattgcagggcgtgggacaggcagcacgtgtcccgttatcggttcttcgggaacgttcgggaccctaagggtccaaccggtcttggacgtcacgcccaacggcccaaaccccg

SEQ ID NO: 423383 - DNA, 568 bp, Homo sapiens
  misc_feature: GZ8MTXP02GG0NI.11.25.C03.1.454.CMB.2.raw
  modified_base (298)..(298): a, c, t, g, unknown or other
  modified_base (356)..(356): a, c, t, g, unknown or other
  modified_base (389)..(389): a, c, t, g, unknown or other
  modified_base (476)..(476): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtcctgagactctcctgtgcagcctcgtgggttcaccgtcagtcacacctacatgagttggccncaggctcgagggagggctggagtggtctctttattacagcagtggtatacatatccgnagactccgtgcggggccattcaccatctcaganacaactcaaagaacacgctgtttactacaaaatgaaacagccctagaacgacgccgaatcgaaccacgggtccgttagtaattacgngtgacgagagagtcggggacccaaacgtaaccgttaacacggtactaagtcgggaacgttcggacggggacccaaacgggggaccaaccggg

SEQ ID NO: 423384 - DNA, 558 bp, Homo sapiens
  misc_feature: GZ8MTXP02G3G4Y.11.25.C03.1.454.CMB.2.raw
  modified_base (374)..(374): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccagggaaggggctggagtgggtctcctttatttacagcagtggtagtacatattccgcagactccgtgngggggccgattcaccatctccagagacaaactctaagaacacgctgttcttacaaatgaacagcctagagagccgatgacacggccgtgtatactgtgcgagacgagtcgggggacccaacggaaacgttacgaacgctaagtcgggaaccgtcgtgggggacccaaagggggacccaaccggg

SEQ ID NO: 423385 - DNA, 572 bp, Homo sapiens
  misc_feature: GZ8MTXP02HY1PC.11.25.C03.1.454.CMB.2.raw
  modified_base (436)..(436): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcagcctcgtgggttcaccgtcagtcacacctacatgagttgggtccgccaggctccgaggggaagggctggagtgggtcttcctttattacagcagtggtagtacatattccgcagactccggtgacgggggcctattccacctatctccagagacaactctaaagaacacgtcttcgtttctanaaaatgaacagcctggagacgccgatacgaccgacgggccgttagtacttacgtgtcgcgaagagtagtcggggacccaacgtaacgttactacgactaagtcggacgtcgtaggggacctaacgggaccctacgg

SEQ ID NO: 423386 - DNA, 583 bp, Homo sapiens
  misc_feature: GZ8MTXP02GRRVJ.11.25.C03.1.454.CMB.2.raw
  modified_base (359)..(359): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttggccgccaggctccgaggggagggctggagtggtctcctttatttacagcagtggtatacatatccganagactccgtggaggggccgattccaccatctaccagagacaaactctaaagacacgcttgtttctacaaaatcgaaacagccctagagagtccctaatcgaaccaccgggtccgttgtaaactttcgtggtgacggaaggagagtcgggggaccccaacggtaaaccgttacacgactaagtcgggaacgttcgtagggggacccaaaggggtacccaaccggg

SEQ ID NO: 423387 - DNA, 537 bp, Homo sapiens
  misc_feature: GZ8MTXP02JVDI3.11.25.C03.1.454.CMB.2.raw
  modified_base (374)..(374): a, c, t, g, unknown or other
  modified_base (435)..(435): a, c, t, g, unknown or other
  modified_base (438)..(438): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggttttcctgttgctatttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtgggtctcctttatttacagcagtggtagtacatattccgcagactccgtgngggggccattcaccatctccagagacaaactctaagaacacgctgttcttcaaatgaaacngcngagagcgatagacgacggcgttagtacttacgtgtgcgagagagtacggaccgacgacgtacgtacgactaagtcgacgtcgtcggacgacggacgacg

SEQ ID NO: 423388 - DNA, 563 bp, Homo sapiens
  misc_feature: GZ8MTXP02F3I2P.11.25.C03.1.454.CMB.2.raw
  modified_base (297)..(297): a, c, t, g, unknown or other
  modified_base (361)..(361): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggtcatcgtcagtcacacctacatgagttgggtccncaggctccgagggaggggctggagtgggtctcctttattacagcagtggtataccatattccgnagactcgtgaggggccattcaccatctccagagacaactctaaagaacacgcttgtttctacaaaatgaaacagcctagagagccgatcgacacggccgtagttattactgtgcgaaggagacgtcgggggaccccaacggtaaaccgttactaacgctaagtcgggaccgtcggtacgggggacccaaacgggggaacccg

SEQ ID NO: 423389 - DNA, 551 bp, Homo sapiens
  misc_feature: GZ8MTXP02FQ4G9.11.25.C03.1.454.CMB.2.raw
  modified_base (377)..(377): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctgggagtgggtctcctttattacagcagtggtagtacatattccgcagactccgtgnggggccattcaccatctccagacgacaactctaaagaacacgtctgtttctacaaatgaacagcctgagagccgatgacaggccgtgtattactgtgcgagagagtcggggacccaacgtaaccgttactacggctaagtggacgtcgtggggaccaacgggggacctaaccgg

SEQ ID NO: 423390 - DNA, 562 bp, Homo sapiens
  misc_feature: GZ8MTXP02G1XV5.11.25.C03.1.454.CMB.2.raw
  modified_base (371)..(371): a, c, t, g, unknown or other
  modified_base (389)..(389): a, c, t, g, unknown or other
  modified_base (540)..(540): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggccgcaggctacgaggggaagggctggagtggtctctttattacagcagtggtagtacatatccgacagactccgtgngggggccatccaccatcnccagacgacaaactacaaagaaccacgtcttgttctacaaatgaactagcctagagacgccgagtcgaaccgacgggccgttagtacttacgtggtagcgaagagacgtcggggacccaacggtaacgtactacgctaagtcggacgtcgnggggaccaacgggacctaccgg

SEQ ID NO: 423391 - DNA, 502 bp, Homo sapiens
  misc_feature: GZ8MTXP02GMA3T.11.25.C03.1.454.CMB.2.raw
  modified_base (357)..(357): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcgggccctcagggatccctgagccgattctctggctccaactctgggaacncagccactctgaccatcagcgggacccaggctatggatgaggctgactattattgtcaggcgtgggacagcagcacgtgcccgttatcgtcttcggaactcgggaccaaggtcaccgtcgttgacgtcacgccaacggccaaccc

SEQ ID NO: 423392 - DNA, 552 bp, Homo sapiens
  misc_feature: GZ8MTXP02FZR98.11.25.C03.1.454.CMB.2.raw
  modified_base (366)..(366): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctggagtgggtctcctttatttacagcagtggtagtacatatccgnagactccgtgcgggggccattcaccatctccagagacaaactctaaagaacacgcttgtttcttacaaatgaacagcctgagagccgatgaccacggctgtattactgtgcgagagagtcgggggacccaacggtaacgttacacgctaagtggacgtcgtagggggaccaaggggaccaaccggg

SEQ ID NO: 423393 - DNA, 614 bp, Homo sapiens
  misc_feature: GZ8MTXP02HBVAU.11.25.C03.1.454.CMB.2.raw
  modified_base (255)..(255): a, c, t, g, unknown or other
  modified_base (438)..(438): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcngcctcgtgggttccaccgtcagtcacacctacatgagttcggccgccaggctccgaggggagggctggagtggtctcctttattacagcagtggtagtacatacttccgcacgactccggtggcgggggcctagttccacctactcctacccgaagacgaacctaaacctacgtaaacgaacncgtactttcgtttacttacaaatcgtaaacacgcctagacgacgccgatcgacgacggtccgttagtacttcgtgtgcgagaggacggtccgggggacccaacggtaaaccgttacctacgacttaagtacgggtaccgttcggacgggggacccgtaacgggggaccctaccggg

SEQ ID NO: 423394 - DNA, 535 bp, Homo sapiens
  misc_feature: GZ8MTXP02JJNCE.11.25.C03.1.454.CMB.2.raw
  modified_base (369)..(369): a, c, t, g, unknown or other
  modified_base (438)..(438): a, c, t, g, unknown or other
  modified_base (470)..(470): a, c, t, g, unknown or other
tcagcgagagataccacgaccggtgctcgatttagtagtgtagatttgggtttgggagaggagcccagcactgggattccgaggtgtttccattcggtgatcagcactgaacacagaggactcaccatggagttttggctgagcgtggtttctgttgctatttaaaggagtccagtgtgaggtgcgtctggtggagtctggaggaggtctgatccagccgtggggggtccctgagactctcctgtgcagcctctgggttcaccgtcagtcacacctacatgagttgggtccgccaggctccgaggggaagggctggagtgggtctcctttattacagcagtggtagtacatattccgcagactccgtgngggggccattcaccatctccagagacaacttcaaagaacacgctgtttcttacaaatgaacagcctganagccgatggaaccacgggccgtagtacttacngtgcgagagagtcgggccgacgacgtacgtacgactaagtgacgtcgtcggcgacggacgaccgg

SEQ ID NO: 423395 - DNA, 550 bp, Homo sapiens
  misc_feature: GZ8MTXP02FVCQJ.11.25.C03.1.454.CMB.2.raw
  modified_base (361)..(361): a, c, t, g, unknown or other
  modified_base (372)..(372): a, c, t, g, unknown or other
  modified_base (387)..(387): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtgggtctctttattacagcagtgtagtacatactccgnagactccgtgngggggccattcaccntctccagacgacaactctaaagaacacgtctgttttctacaaatgaacagcctgacgagccgatgaccacggctagtattactgtgcgagagagtcggggacccaacggaacgttacacgtactaagtcggacgtcggacggggaccaacggggacctaacgg

SEQ ID NO: 423396 - DNA, 529 bp, Homo sapiens
  misc_feature: GZ8MTXP02IWOVW.11.25.C03.1.454.CMB.2.raw
  modified_base (315)..(315): a, c, t, g, unknown or other
  modified_base (356)..(356): a, c, t, g, unknown or other
  modified_base (371)..(371): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctnagggatccctgagcgattctctggctccaactctgggaacncagccactctgaccntcagcgggaccagctagtggatgaggctgactattattgtcagggcgtggacagcagcactgcccgttatcgttcgtcggaaacgttcggggaaccaaacggtccaaccggttcgttacggacgttacacggaccccgaacggacccctaaacccccg

SEQ ID NO: 423397 - DNA, 603 bp, Homo sapiens
  misc_feature: GZ8MTXP02IG73U.11.25.C03.1.454.CMB.2.raw
  modified_base (370)..(370): a, c, t, g, unknown or other
  modified_base (372)..(372): a, c, t, g, unknown or other
  modified_base (396)..(396): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctctgggttcacgtcagtcacacctacatgagttggccgccaggctccgaggggaagggctggagtggtctcctttatttacagcagtggtagtacatattccgcagactccgngngggggccattccaccatctcaganacaactacaagaacacgtcttgtttactacaaaatgaaacagcctaggagacgcccgatacgaccgacgggtccgttagtaactttacgtggtcggacgaaggaggacgtcgggggacccccaaacggtaaccgtttaactaccggacttaagttcggggaacccttcgggacgggggaccccgaaaagggggacccctaaccgggg

SEQ ID NO: 423398 - DNA, 517 bp, Homo sapiens
  misc_feature: GZ8MTXP02IQ2IU.11.25.C03.1.454.CMB.2.raw
  modified_base (361)..(361): a, c, t, g, unknown or other
  modified_base (376)..(376): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccacccctcagtgtcccgtgtccccaggacagacagccagaatcccctgctctggaattgaattgagagataaatatacttgttggtatcaacagaagccaggccagtccccctgattggtcatctatcaagatgtgaagcgggccctcagggatcccctgagcccgattctctggctccaactctgggaacncagccactctgaccntcagcgggacccaggctatggatgagctgactattagttgcaggcgtgggacaggcagcacgtgcccgttatcgttcttcgggaaacttcgggaccaacggtcaccgtgttcgacggtcaggcccaacggaccaaaccccg

SEQ ID NO: 423399 - DNA, 596 bp, Homo sapiens
  misc_feature: GZ8MTXP02HN4EN.11.25.C03.1.454.CMB.2.raw
  modified_base (359)..(359): a, c, t, g, unknown or other
  modified_base (368)..(368): a, c, t, g, unknown or other
  modified_base (411)..(411): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggttcaccgtcagtcacacctacatgagtggccgcaggctcgaggggagggctggagtggtcttctttattacagcagtgtagtacatatccgnagactccgnggcggggccattcaccatcaccagaacacaaactcaaagaacncgtcttgtttactacaaaatcgaaacagcctaggaagacgcccgagtacgaccgacgggtccgttagttaacttacgtggtacgacggaagaggtacggtccgggggaccccaaacggtaaaccgtttacaacgtcttaagtcggggaacgttcggacgggggacccgaaaacggggacccacgg

SEQ ID NO: 423400 - DNA, 645 bp, Homo sapiens
  misc_feature: GZ8MTXP02IIB0O.11.25.C03.1.454.CMB.2.raw
  modified_base (383)..(383): a, c, t, g, unknown or other
  modified_base (478)..(478): a, c, t, g, unknown or other
  modified_base (523)..(523): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtggggttccaccgtcagtcaccacctacatggaggttcgggtcccgccaggcctccggaggggaaggggctgggaggtgggtcttccttttatttacagcagtggtagtacatattccgnacgactccggtggacgggggcctattccacctactcctaccagacgaacaaacttactaaagaaaccacgtcttgtttactacaaaatcgaaacngcctagacgagcccgatcggaaccacgggccgttagtacttacgnggtagacggtagaacggtacggtcggggacccccaaacgggtaaaccgtttactaccggacttaacggtcgggtaaccggttcggacgggggtaccccaaacgggggtaccctacccggggg

SEQ ID NO: 423401 - DNA, 549 bp, Homo sapiens
  misc_feature: GZ8MTXP02F31FQ.11.25.C03.1.454.CMB.2.raw
  modified_base (364)..(364): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccaggggaaggggctggagtgggtctcctttattacagcagtggtagtacatattccgnagactccgtgacgggggccattcaccatctccagagacaaactctaaagaacacgtctgtttcttacaaatgaacagcctagagagccgatgaccacggccgtagtacttactgtgcgagagagtcggggaccacgaacgttacacgctaagtcggacgtcgtggggaccaacgggacctaccgg

SEQ ID NO: 423402 - DNA, 570 bp, Homo sapiens
  misc_feature: GZ8MTXP02G3APZ.11.25.C03.1.454.CMB.2.raw
  modified_base (374)..(374): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggagggctggagtggtctcctttatttacagcagtggtagtacatattccgcagactccgtgngggggccgattcaccatctccagagacaaactctaaagaacacgctgtttcttacaaatgaacagcctagagagcccgatgaccgacggccgtagtattactgtgcgagagagtcgggggacccaacgtaacgttacctaccgcgtaagtcgggtaaccggtcgtcgggggaccgaaacgggggacccaaccgggg

SEQ ID NO: 423403 - DNA, 542 bp, Homo sapiens
  misc_feature: GZ8MTXP02HJUTF.11.25.C03.1.454.CMB.2.raw
  modified_base (340)..(340): a, c, t, g, unknown or other
  modified_base (478)..(478): a, c, t, g, unknown or other
  modified_base (510)..(510): a, c, t, g, unknown or other
  modified_base (518)..(518): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtggtttctgttagctatttaaaaggagtcagtgtgaggtgcgtctggtggagtctggaggaggcctgatccagccgtggggggtccctgagactctcctgtgcagcctcgtgggttcaccgtcagtcacacctacatgagttcgggtccgccaggctcgaggggaagggctggagtgggtctcctttattacngcagtggtagtacatattccgcagtactccggtgacgggggccattccaccattcaccagacgacaactctaaagaacacgcttgtttactacaaatgaacaggcctagagacgccgatcgacgacggcgtgtattcngtgcgagagagtcggggaccaacgtacgtacncgctaagngacgtcgcggacgacggcctacgg

SEQ ID NO: 423404 - DNA, 513 bp, Homo sapiens
  misc_feature: GZ8MTXP02GSRHY.11.25.C03.1.454.CMB.2.raw
  modified_base (358)..(358): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagcaggccagtcccctgtattggtcatctatcaagatgtgaagcggccctcgagggactccctgagccgattctctggctccaactcgtgggaacncagccactctgaccatcagcgggacccaggctatggatgagctgacttattattgtcagggcgtggggacaggcaacgctcgcgttactgtcgttcgtacgtcggacgacgtacgtaccgtacgttgacgtcgacgaccgacgaccgacccaccg

SEQ ID NO: 423405 - DNA, 556 bp, Homo sapiens
  misc_feature: GZ8MTXP02IZBAL.11.25.C03.1.454.CMB.2.raw
  modified_base (359)..(359): a, c, t, g, unknown or other
  modified_base (370)..(370): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgaggggaagggctggagtggtctctttattacagcagtggtatacatatccgnagactccgtgngggggccattcaccatctaccagagacaaactctaaagaacacgcttcgtttacttacaaaatgaaacagcctgagagccgatgacacggcgtgtaattactgtgcgaagagagtcggggacccaaacggaacgttactacggctaagtcggaacgttcgaggggacccaaaggggaccctacggg

SEQ ID NO: 423406 - DNA, 587 bp, Homo sapiens
  misc_feature: GZ8MTXP02J3K8K.11.25.C03.1.454.CMB.2.raw
  modified_base (421)..(421): a, c, t, g, unknown or other
  modified_base (429)..(429): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgaggggagggctggagtgggtcttcctttattacagcagtggtagtacatattccgcagctccggtgcgggggccattcaccatctaccagagacaactctaaagaccacgcgttnttactaanaaatcaacgcgtcgagagcgacgtagacgaacgtcccggtcgttagtacttacgtgacgagagaggacgggtccgggacctaacggttaaccgtacgtaccgtacgtaagtacgggtaccgtcggggtaccggggaccgaaacgggccgtaacccggg

SEQ ID NO: 423407 - DNA, 525 bp, Homo sapiens
  misc_feature: GZ8MTXP02HK5HE.11.25.C03.1.454.CMB.2.raw
  modified_base (415)..(415): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccacctcagtgtccgtgtccccaggacagacagccagaatccctgctctggaattgaattgagagataaatatacttgttggtatcaacagaagccaggccagtcccctgtatggtcatctatcaagatgtagaagcggccctcgagggatcccctgagccgattctctggctccaactcgtgggaacgcacgccactctcgaccatcaggccgggacccaggctagtggatgaggctagactattnttgcagggcgtggacagcagcacgtcgcccgttatcgtcgttacggaacgttcgggacctaaaggtccaccgttcgttgacgtcaacggccccaaggaccccaaaccccg

SEQ ID NO: 423408 - DNA, 559 bp, Homo sapiens
  misc_feature: GZ8MTXP02GQOW6.11.25.C03.1.454.CMB.2.raw
  modified_base (368)..(368): a, c, t, g, unknown or other
  modified_base (379)..(379): a, c, t, g, unknown or other
  modified_base (395)..(395): a, c, t, g, unknown or other
  modified_base (401)..(401): a, c, t, g, unknown or other
  modified_base (478)..(478): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggaaggggctgggagtgggtctcctttatttacagcagtggtagtacatatccgnagactccgtgnggggccatcaccatcnccaganacaactcaaagaacacgcttgtttctacaaatgaaacagcctagagagccgatcgaaccacggccgtagtacttacngtgcgagagagtcgggggacccacggtaacgttactacgctaagtcggacgtcgtacggggaccaaaggggaccctacggg

SEQ ID NO: 423409 - DNA, 560 bp, Homo sapiens
  misc_feature: GZ8MTXP02GK7EM.11.25.C03.1.454.CMB.2.raw
  modified_base (358)..(358): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttggccgcaggctccgagggagggctggagtggtctctttattacagcagtggtagtacatatccgnagactccggtgacgggggccattccaccatctccagagacaactctaaagacacgctgtttctacaaatgaacagcctgagagcgatgacgcggtcgtgtacttacgtgtgcgagacgagtacgggggacccctaacggtaaacgttaccgtacgactaagtcggtaacgtcggtcggggacccaaacggggacccaccggg

SEQ ID NO: 423410 - DNA, 539 bp, Homo sapiens
  misc_feature: GZ8MTXP02F2D3C.11.25.C03.1.454.CMB.2.raw
  modified_base (361)..(361): a, c, t, g, unknown or other
  modified_base (372)..(372): a, c, t, g, unknown or other
  modified_base (518)..(518): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggccgccaggctccgaggggaagggctggagtgggtctcctttattacagcagtgtagtacatatccgnagactccgtgngggggccattcaccatctccagagacaactctaaagaacacgctgtttcttacaaatgaacagcctgagagccgatgacacggccgtgtattactgtgcgagagagtcgggggacccacgaacgttacacgctaagtggacgtcgnggggaccaacgggacctacgg

SEQ ID NO: 423411 - DNA, 553 bp, Homo sapiens
  misc_feature: GZ8MTXP02GT8CM.11.25.C03.1.454.CMB.2.raw
  modified_base (341)..(341): a, c, t, g, unknown or other
  modified_base (360)..(360): a, c, t, g, unknown or other
  modified_base (385)..(385): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggctccgaggggagggctggagtgggtctctttattacngcagtgtatacatatccgnagactccgtgcggggcatcacatcnccagagacaactctaaagacacgtcttgtttcttacaaatgaaacagcctaggacgagcccgatacgacgacggccgttagtacttacgtgtgcgagaggagtcggggacccaacggaacgttacacgctaagtcggacgtcggtggggaccaacggggaccctacgg

SEQ ID NO: 423412 - DNA, 560 bp, Homo sapiens
  misc_feature: GZ8MTXP02I2KGW.11.25.C03.1.454.CMB.2.raw
  modified_base (339)..(339): a, c, t, g, unknown or other
  modified_base (360)..(360): a, c, t, g, unknown or other
  modified_base (396)..(396): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcctgttgctatttaaaaggagtcagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctgggagtgggtctcctttattacngcagtggtagtacatatccgnagactccgtgcgggggccattccaccatctccaganacaactcaaagaacacgcttgtttcttacaaaatgaactagcctggaagagcccgatacgaccacgggccttgtaacttgtgtgacgagagagtcgggggacccaacggaacgtttaccacgctaagtcggacgttcgcgggggaccaagggggtacccacggg

SEQ ID NO: 423413 - DNA, 586 bp, Homo sapiens
  misc_feature: GZ8MTXP02JEWKH.11.25.C03.1.454.CMB.2.raw
  modified_base (298)..(298): a, c, t, g, unknown or other
  modified_base (375)..(375): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccnccaggctccgaggggaagggctggagtgggtctcctttatttacagcagtgtagtacatattccgcagactccgtgngggggccattccaccatctccagacgacaaactactaaagaacacgcttgtttacttacaaaatgaaactagccctggaagacgccgaatcgaaccgacgggccgttaggtaactttacgtgtcgacgaaggagagtcgggggaccccaacggtaaccgttacacgctaagcggaacgtcggtcgggggaccaaacggggacctaaccggg

SEQ ID NO: 423414 - DNA, 556 bp, Homo sapiens
  misc_feature: GZ8MTXP02I7J2W.11.25.C03.1.454.CMB.2.raw
  modified_base (363)..(363): a, c, t, g, unknown or other
  modified_base (481)..(481): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtgggtttcctgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggcctccgaggggagggctggagtgggtctcctttattacagcagtggtatacatatccanagactccggtgacgggggccattccacctatcctaccagagaccaactctaaagaacacgcttgtttacttacaaatgaacagcctagagacgcgatcgacacggcgtagtattacgngtgcgacgagagtcgggaccgacgtaacgtacgtacgacgtaacgtagacgtcgtacggacggacggacgaccgg

SEQ ID NO: 423415 - DNA, 581 bp, Homo sapiens
  misc_feature: GZ8MTXP02GKH7U.11.25.C03.1.454.CMB.2.raw
  modified_base (365)..(365): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtcagtcacacctacatgagttgggccgccaggctccgaggggagggctggagtgggtcttcctttattacagcagtggtagtacatactccgnagactccggtggacgggggccattccaccatctaccagacgaactaaactctaaagaacacgtcttagtttctacaaatgaaactagcctagagacgccgatcgaccgacggtccgttagttacttacgtggtcgacgagacggagtcgggggacccaacggtaaccgttacacgctaagtcggacgtcggtacggggaccaacggggcctaccgg

SEQ ID NO: 423416 - DNA, 575 bp, Homo sapiens
  misc_feature: GZ8MTXP02HRABL.11.25.C03.1.454.CMB.2.raw
  modified_base (358)..(358): a, c, t, g, unknown or other
  modified_base (367)..(367): a, c, t, g, unknown or other
  modified_base (369)..(369): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttggtccgcaggctccgaggggagggctggagtgggtctcctttattacagcagtgtagtacatatccgnagactccgngnggggccatcaccatctcagagacaactctaaagacacgtctgtttctacaaaatgaaacagcctagagacgccgatgacgacggcctagtacttacgtgtgacggaagaggagtcgggggacccctaaacggtaaaccgttacctaacggccttaagtcgggaaccgttcggagggggaccccaaaagggggtaccccaaccgggg

SEQ ID NO: 423417 - DNA, 591 bp, Homo sapiens
  misc_feature: GZ8MTXP02G3X4U.11.25.C03.1.454.CMB.2.raw
  modified_base (260)..(260): a, c, t, g, unknown or other
  modified_base (345)..(345): a, c, t, g, unknown or other
  modified_base (497)..(497): a, c, t, g, unknown or other
  modified_base (507)..(507): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctntgggttcaccgtcagtcacacctacatgagttcgggtccgccaggctccgaggggaaggggctggagtgggtctcctttattacngcagtggtagtacatacttccgcagactccggtggacgggggcctaattccacctatcctccagacgacaaactctaaagacacgtcttgttcttacaaatgaactagcctaggagagcccgaatcgaaccgacgggccgtgtaacttacgngtgcggaagngacgtcggggaccctaacggtaaccgttaccacggtactaacggttggaaccgttcgcgggggaccaacggggaccctaccggg

SEQ ID NO: 423418 - DNA, 565 bp, Homo sapiens
  misc_feature: GZ8MTXP02F6TB8.11.25.C03.1.454.CMB.2.raw
  modified_base (366)..(366): a, c, t, g, unknown or other
  modified_base (377)..(377): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggaagggctggagtgggtcttcctttatttacagcagtggtagtacatattccgnagactccgtgnggggccattcaccatctccagacgacaaactctaaagaacacgcttgtttacttacaaatcgaacagcctagagacgccgatgaaccgcggtccgtgttaattactgtgcgagaggacgtcgggggaccccaagtaacgttacacggactaagtggacgtcgtacggggaccaacggggacctacggg

SEQ ID NO: 423419 - DNA, 611 bp, Homo sapiens
  misc_feature: GZ8MTXP02G40OS.11.25.C03.1.454.CMB.2.raw
  modified_base (244)..(244): a, c, t, g, unknown or other
  modified_base (246)..(246): a, c, t, g, unknown or other
  modified_base (257)..(257): a, c, t, g, unknown or other
  modified_base (262)..(263): a, c, t, g, unknown or other
  modified_base (274)..(274): a, c, t, g, unknown or other
  modified_base (285)..(285): a, c, t, g, unknown or other
  modified_base (297)..(297): a, c, t, g, unknown or other
  modified_base (299)..(299): a, c, t, g, unknown or other
  modified_base (302)..(302): a, c, t, g, unknown or other
  modified_base (322)..(322): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtggtttcgtgtagctatttaaagagtcagtgtgaggtgcgtctggtggagtctggaggaggcctgatccagcctggggggtccctgagactctctgncngctcgtggtcncgtcnncacacacatgngtcggtcgcgngcgcgaggaggngnggngtggtcttctttattacagngtagtagtagtatactactacacacgacgtcgtcggcgggacgtactacaccactactacacgacgaacaactactaacgaacgacgtacttactttacttaactaaatacgaacgacgtaccgtacgagacgacggacgtacgaccgaccggtacgtacgttagttacgtagtaggacggacggacggtacggtaccgggtacccggtaaaccggtaaccgttaacgtaacgtacgtaacggtacggtacggtacggtacgggtaccggaaccgggaaccggtaccgg

SEQ ID NO: 423420 - DNA, 581 bp, Homo sapiens
  misc_feature: GZ8MTXP02GVM9U.11.25.C03.1.454.CMB.2.raw
  modified_base (273)..(273): a, c, t, g, unknown or other
  modified_base (298)..(298): a, c, t, g, unknown or other
  modified_base (489)..(489): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtnagtcacacctacatgagttggtccnccaggctccgaggggaagggctggagtgggtctcctttattacagcagtgtagtacatatccgcagactccggtgcgggggccattccacatctccagacgacaactctaaagacacgtcttgtttaccttaacgaaatcgaaacacgccgtagacgagcccagtcgaaccgcggccgttgtaacttacgngtgacggagacggacgtacggggacccaacggtaaccgttaccacgtactaagtcggaacggttcgacgggggaccaacggggaccaccggg

SEQ ID NO: 423421 - DNA, 611 bp, Homo sapiens
  misc_feature: GZ8MTXP02HMU16.11.25.C03.1.454.CMB.2.raw
  modified_base (372)..(372): a, c, t, g, unknown or other
  modified_base (390)..(390): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggccgccaggctccgagggagggctggagtggtctcctttatttacagcagtggtagtacatattccgcagactccgtgngggggccattcaccatcncagagacactcaaagacacgcttgtttactacaaatcgaacagtccctggaagacggccgagtacgaacccgacggggcccgttaggttaacttaccgtgggtacggaccggtaaggacggtaaggtccgggggaccccctaaacggtaaacccgtttaacgaccgacgttaagtcgggaaccgtcggtacgggggacccaaacgggggaccctacccggg

SEQ ID NO: 423422 - DNA, 540 bp, Homo sapiens
  misc_feature: GZ8MTXP02HM5LM.11.25.C03.1.454.CMB.2.raw
  modified_base (358)..(358): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgtggtatcaacagaagccaggccagtcccctgtattggtcatctatcaagatgtgaagcggccctgagggactccctgagccgattctctggctccaactcgtgggaaacncagcccactctgacccatcagccgggacccaggctatggatgagctagacttattattgcagggcgtgggacagcagtcacgtcgacccgttatcgtcttacggaacgttcggggaaccctaaagggtccaacccggtttgttacggacgtccgaacgacccgaaaccggaccccaaacccg

SEQ ID NO: 423423 - DNA, 551 bp, Homo sapiens
  misc_feature: GZ8MTXP02I7S8L.11.25.C03.1.454.CMB.2.raw
  modified_base (342)..(342): a, c, t, g, unknown or other
  modified_base (374)..(374): a, c, t, g, unknown or other
  modified_base (389)..(389): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctcgtgggttcaccgtcagtcacacctacatgagttggtccgccaggctccgaggggaagggctggagtggtctcctttatttacngcagtggtatacatattccgcagactccgtgngggggccattcaccntctccagagacaactctaaagaacacgcttgtttctacaaatgaaacagcctagagacgccgatagaccacgggccgtgtaacttacgtgtgacgagagagtcgggacccaacgaccgttacacgctaagcggacgtcgtaggggaccaacgggacctacgg

SEQ ID NO: 423424 - DNA, 505 bp, Homo sapiens
  misc_feature: GZ8MTXP02GCIBH.11.25.C03.1.454.CMB.2.raw
  modified_base (359)..(359): a, c, t, g, unknown or other
  modified_base (403)..(403): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggactccctgagccgattctctggctccaactcgtgggaacncagccactctgaccatcagcgggacccaggctagtgatgaggcngacttatatgtcagggcgtagggacagcagcactgcccgttatcgtctcggaactcgggaccaaggtcacggtcttgacgtcagcccaacggcccaaacccg

SEQ ID NO: 423425 - DNA, 611 bp, Homo sapiens
  misc_feature: GZ8MTXP02HE601.11.25.C03.1.454.CMB.2.raw
  modified_base (358)..(358): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgatccagcctgggggtccctgagctctcctgtgcagcctctgggttcaccgtcagtcacacctacatgagttgggtccgcaggctccgaggggaggggctggagtgggtctcctttatttacagcagtgtagtacatatccgnagactccgtgcggggcattccacatctccagacgacaaactctaaaggaaccacgtcttcgtttacttacctaaatagaaccgaacgtccgttagacggacgaccgtagtacgaccgaaccgggtcccgtcggttaattaccgttaggtacggcggaaggacggaggtaccgggggtacccgaaaccgtaaccgttaacgtacgactaagtcggacggtacggtcgggggaccgaacggggaaccgtacccgg

SEQ ID NO: 423426 - DNA, 573 bp, Homo sapiens
  misc_feature: GZ8MTXP02IVG40.11.25.C03.1.454.CMB.2.raw
  modified_base (361)..(361): a, c, t, g, unknown or other
  modified_base (475)..(475): a, c, t, g, unknown or other
  modified_base (485)..(485): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctctgggttcaccgtcagtcacacctacatgagttcggccgccaggctccgaggggaagggctggagtgggtctcctttattacagcagtgtagtacatattccgnagactccgtgcgggggccattcaccatctccagacgacaactctaaagaacacgtctgtttctacaaatgaacagcctagagagccgatcgaaccgacggccgtgtaacttcgngtgcggaagngaagtcgggggaccccaacggtaaccgtttactacggtacctaagtcggaaccgtcgtacgggggaccctaaaggggaccctaccggg

SEQ ID NO: 423427 - DNA, 547 bp, Homo sapiens
  misc_feature: GZ8MTXP02HZVWM.11.25.C03.1.454.CMB.2.raw
  modified_base (384)..(384): a, c, t, g, unknown or other
  modified_base (389)..(389): a, c, t, g, unknown or other
  modified_base (460)..(460): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggtttccttgttgctatttaaaaggagtccagtgtgaggtgcgtctggtggagtctgggaggaggcctgatccagccgtgggggtccctgagactctcctgtgcagcctgtgggttcaccgtcagtcacacctacatgagttcggccgcaggctccgaggggagggctggagtggtctctttattacagcagtggtagtacatatccgcagactccggtgcggggccatcacatcncaganacaactctaaagacacgcttgttctacaaatgaaacagcctagagagcgatgacgacggcgtgtattacgngtgcgagagagtcggggaccctaacggtaaccgttactacgcttaagcggtaacgttcgacggggacccaaacggggacccaccggg

SEQ ID NO: 423428 - DNA, 534 bp, Homo sapiens
  misc_feature: GZ8MTXP02FT2OS.11.25.C03.1.454.CMB.2.raw
  modified_base (362)..(362): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctccggaattgaattgagagataaatatacttgttggtatcaacagaagccaggccagtcccctgtattggtcatctatcaagatgtgaagcggccctcgagggtactcccgtgagcgatttctctggctccaactcgtgggaacncacgccactctcgaccatcacggccgggacccaggctagtggatgaggctgtacttattattgcgtagggcggtggacaggcagcacgtcgtccgttatcggtcttcggaacgtcgggaacctaggtaccaccgttcgtgactcgacgtcccgaacggcccaaccccgtacg

SEQ ID NO: 423429 - DNA, 575 bp, Homo sapiens
  misc_feature: GZ8MTXP02JMGRE.11.25.C03.1.454.CMB.2.raw
  modified_base (361)..(361): a, c, t, g, unknown or other
  modified_base (371)..(371): a, c, t, g, unknown or other
  modified_base (486)..(486): a, c, t, g, unknown or other
  modified_base (532)..(532): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctgtgggttcaccgtcagtcacacctacatgagttggccgccaggcctccgaggggagggctggagtgggtctcctttattacagcagtgtagtacatattccgnagactcgtgngggggccattccaccatcctaccagacgacaactactaaagaactacgcttcgttcttacaaatgaaacagccgtagagacgaccgagtacgacgaccggtcctagtacttacgngtcgcgaaggagaggtcggggacccaaaggtaaccgttacgaccgntaagtcggacgtcggtaggggacccaacgggggaccctacggg

SEQ ID NO: 423430 - DNA, 603 bp, Homo sapiens
  misc_feature: GZ8MTXP02H0S4P.11.25.C03.1.454.CMB.2.raw
  modified_base (261)..(261): a, c, t, g, unknown or other
  modified_base (371)..(371): a, c, t, g, unknown or other
  modified_base (382)..(382): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctgggaggaggcctgatccagccgtggggggtccctgagactctcctgtgcagcctntgggttcaccgtcagtcacacctacatgagttgggtccgccaggcctccgaggggaaggggctgggagtggggttctcctttatttacagcagtggtagtacatatccgnagactccgtgnggggcattccaccatctacagagacaactctaaagaacacgtcttcgtttacttacaaaattcgaaacacgcctagacggtacgcccgatcggaaccacgggccgtttagtaactttacgtggtgcggaaggagacggtcgggggaccccaaacggtaaccgttactaccggcttaagtcggaacggtcgtacgggggaccaaacggggtacccgtaccgg

SEQ ID NO: 423431 - DNA, 561 bp, Homo sapiens
  misc_feature: GZ8MTXP02H0O2V.11.25.C03.1.454.CMB.2.raw
  modified_base (358)..(358): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagcctggggggtcctgagactctcctgtgcagcctctgggttcaccgtcagtcacacctacatgagttgggtccgccaggctccgaggggagggctggagtggtctcctttattacagcagtggtagtacatatccgnagactccgtgcgggggcctattccacctatcctacagacgacaaactctaaacgaacacgtctgtttcttacaaatgaaacagcctgagagccgatcgacgacggccgtagtattactggtagcgagagagtcgggggacccaacggtaacgttcacgtctaagtcggacgtcggtaggggacccgaaggggtacccaccggg

SEQ ID NO: 423432 - DNA, 550 bp, Homo sapiens
  misc_feature: GZ8MTXP02INFV9.11.25.C03.1.454.CMB.2.raw
  modified_base (296)..(296): a, c, t, g, unknown or other
  modified_base (372)..(372): a, c, t, g, unknown or other
  modified_base (395)..(395): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagactctcctgtgcagcctctgggttcaccgtcagtcacacctacatgagttgggtccnccaggctccgaggggaagggctgggagtgggtctcctttatttacagcagtgtagtacatatccgcagctccgtgnggggccatcaccatctaccaganacaaactctaaagaacacgtcttgtttacaacaaatgaaacagcctagagagccgaatcgacaccggtcgtagtattactgtagcgtagagacgtcgggaccaacgtaacgttacacgactaagtcggacgtcgagggaccgaagggacctacgg

SEQ ID NO: 423433 - DNA, 545 bp, Homo sapiens
  misc_feature: GZ8MTXP02FMST9.11.25.C03.1.454.CMB.2.raw
  modified_base (473)..(473): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctggagtgggtctcctttattacagcagtggtagtacatattccgcagactccgtgaggggccgattcaccatctccagagacaactctaaagacacgctgtttcttacaaatgaacagcctgacgagccgatgaccacggccgtgtattacngtgcgagagagtcggggcccacgaacgttacacgctaagtcggacgtcgtaggggaccaacgggacctacgg

SEQ ID NO: 423434 - DNA, 544 bp, Homo sapiens
  misc_feature: GZ8MTXP02JNQGR.11.25.C03.1.454.CMB.2.raw
  modified_base (341)..(341): a, c, t, g, unknown or other
  modified_base (373)..(373): a, c, t, g, unknown or other
  modified_base (405)..(405): a, c, t, g, unknown or other
  modified_base (422)..(422): a, c, t, g, unknown or other
  modified_base (440)..(440): a, c, t, g, unknown or other
  modified_base (478)..(478): a, c, t, g, unknown or other
  modified_base (503)..(503): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaagggctggagtggtctcctttattacngcagtgtagtacatattccgcagactccgtgnggggccattccaccatctccagacgacaactnaagacacgctgttctanaaatgaacagcctgacgnccgatcgacgacggccgtgtacttacgtgtgcgagagngtcggggacccaacggaacgttacncgactaagtcggacgtcggtaggggccaacgggcctaccgg

SEQ ID NO: 423435 - DNA, 552 bp, Homo sapiens
  misc_feature: GZ8MTXP02GJK02.11.25.C03.1.454.CMB.2.raw
  modified_base (301)..(301): a, c, t, g, unknown or other
  modified_base (365)..(365): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccnccaggctccgaggggagggctgggagtgggtctcctttattacagcagtgtagtacatatccgnagactccgtgacggggccattcaccatctcagagacaactcaaagacacgtcttgtttactacaaatgaaacagcctgagagccgatgaaccgacggctgtattactgtgcgtagacgagtcggggacccaaggaaccttacgacgctaagtcggacgttcgacggggccaaacggggccctaacgg

SEQ ID NO: 423436 - DNA, 507 bp, Homo sapiens
  misc_feature: GZ8MTXP02H9YXR.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtcccgtgtccccaggacagacagccagaatcccctgctctggaattgaattgagagataaatatacttgttggtatcaacagaagccaggccagtccccctgtattggtcatctatcaagatgtgaagcggccctcagggatccctgagccgattctctggctccaactctgggaacgcagccactctgaccatcagcgggacccaggctatggatgagctgactattattgtcaggcgtgggacagcagcactgcccgttatcgtctcggaactcgggaccaagggtcaccggtcttgacgtcgacgcccaaggcccaaaccccg

SEQ ID NO: 423437 - DNA, 584 bp, Homo sapiens
  misc_feature: GZ8MTXP02JN7IP.11.25.C03.1.454.CMB.2.raw
  modified_base (363)..(363): a, c, t, g, unknown or other
  modified_base (486)..(486): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggactccccgtgagccgattctcgtcggctccaactcgtgggaacncacgccactctacgaccatcagcgggaacccagggctagtcggaatggaggctaggtaacttagtttaattcggtacgaaggggtcgtaggggacaggcaagccaacgtcggaccccgtttanacgttccgttacgggtaaaccgttacggggaaccgtaacggttaccgaaccgtccgttgtacgtacgaaccgacccgaaaccggacccgaaacccccg

SEQ ID NO: 423438 - DNA, 561 bp, Homo sapiens
  misc_feature: GZ8MTXP02J1DRG.11.25.C03.1.454.CMB.2.raw
  modified_base (377)..(377): a, c, t, g, unknown or other
  modified_base (417)..(417): a, c, t, g, unknown or other
  modified_base (459)..(459): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctggagtgggtctcctttattacagcagtggtagtacatattccgcagactccggtgngggggccattccacatctccagacgacaactcaaagaacncgcttgtttctacaaatgaacagcctgagagccgatagaccncggcgtgttattactgtgcgagaggagtcgggggaccccaacggtaacgttacacgtctaagtcgggacgtcggtcgggggaccaacgggggaccctacggg

SEQ ID NO: 423439 - DNA, 602 bp, Homo sapiens
  misc_feature: GZ8MTXP02JU6C7.11.25.C03.1.454.CMB.2.raw
  modified_base (347)..(347): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcatacctacatgagttgggtccgccaggcctccgaggggaaggggctggagtgggtcttcctttatttacngcagtggtagtacatatccgcagactccggtggcgggggccattccaccatcctccagacacaactctaaagacacgcttgtttcttaacaaatgaaactagcctagagagccgatcgaccacgggcctagtattacgtgtcgacggtaagagacggtcgggggacccccaaacgggtaaaccgttacgtaaccgtccttaaggtcgggtaaccggttcggtaccgggggacccaaacgggggacccctaccggg

SEQ ID NO: 423440 - DNA, 547 bp, Homo sapiens
  misc_feature: GZ8MTXP02G7UA5.11.25.C03.1.454.CMB.2.raw
  modified_base (341)..(341): a, c, t, g, unknown or other
  modified_base (373)..(373): a, c, t, g, unknown or other
  modified_base (390)..(390): a, c, t, g, unknown or other
  modified_base (414)..(414): a, c, t, g, unknown or other
  modified_base (476)..(476): a, c, t, g, unknown or other
  modified_base (478)..(478): a, c, t, g, unknown or other
  modified_base (510)..(510): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgcaggctccgaggggaagggctggagtgggtctctttattacngcagtgtagtacatattccgcagactccgtgnggggccattccacatcncagagacaactacaaagacacgtntgtttcttacaaaatgaaacagtcctagagagccgatgaaccgacggccgtagtatttacgngngagagagagcgggaccaacgtaacgtacacgntaagcggtacgtcggacgggaccaacgggacctacgg

SEQ ID NO: 423441 - DNA, 558 bp, Homo sapiens
  misc_feature: GZ8MTXP02J1WAO.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggccgccaggctccgaggggagggctggagtgggtctcctttattacagcagtggtagtacatattccgcagactccggtgcgggggccattccaccatctccagagacaactctaaagaacacgcttgtttcttacaaatgaacagcctgagagccgatgacacgggccgtgtacttactgtgcgaggagagtcgggggaccccaacggaacgttactacggactaagtcggacgtcgtcgggggaccaacggggaccctaacggg

SEQ ID NO: 423442 - DNA, 565 bp, Homo sapiens
  misc_feature: GZ8MTXP02ICDG5.11.25.C03.1.454.CMB.2.raw
  modified_base (446)..(446): a, c, t, g, unknown or other
  modified_base (483)..(483): a, c, t, g, unknown or other
  modified_base (493)..(493): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctggaggaggcatgatccagccgtgggggtcctgagactctcctgtgcagcctcgtgggtcaccgtcagtcacacctacatgaggttgggtccgccaggcctccgaggggaggggctgggagtgggtctctttatttacagcagtggtatacatatccgcagacctccgtggacggggccattccaccatcctcccagacgacaactctaaagaaccacgcttgtttactacaaatgaaacngcctgaagacgcgatgacacggccgtagtacttacgngtcgcgaggngacgtcgggggacccaacgtaacgtttaccacgcgtagtacggaccgtcgtacgggggaccaaacggggccc

SEQ ID NO: 423443 - DNA, 512 bp, Homo sapiens
  misc_feature: GZ8MTXP02F0GBR.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggactcccgtgagccgattctctggctccaactctgggaacgcagccactctcgaccatcagcgggacccaggctatgatgagctgactattatgtcgaggcgtagggacagcagcacgtcgcccgttagtcgtcttcgggaactcggggaccaacggtccacgtcgtgacgtcacgcccaacggcccaaacccg

SEQ ID NO: 423444 - DNA, 581 bp, Homo sapiens
  misc_feature: GZ8MTXP02ICB34.11.25.C03.1.454.CMB.2.raw
  modified_base (439)..(439): a, c, t, g, unknown or other
tcagcgagagataccacgaccggtgctcgatttagtagtgtagatttgggtttgggggacaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttcgggccgccaggcctccgaggggaaggggctggagtgggtctcctttattacagcagtggtagtacatatccgcagactccgtggcgggggccattccaccatctccaagacgacaactactaaagaacacgtcttgtttacttanaaatgaacagcctgagacgccgatcgaccacgggccgttgtaacttacgtgtcgcgagagagtcgggggacccaacggtaaccgttactacgacttaagtcggaaccgttcggacgggggacccaaacggggaccctaccgg

SEQ ID NO: 423445 - DNA, 561 bp, Homo sapiens
  misc_feature: GZ8MTXP02HLV2C.11.25.C03.1.454.CMB.2.raw
  modified_base (367)..(367): a, c, t, g, unknown or other
  modified_base (378)..(378): a, c, t, g, unknown or other
  modified_base (442)..(442): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggaagggctggagtgggtctcctttatttacagcagtggtagtacatattccgnagactccgtgngggggccattccaccatctccagagacaactctaaagaacacgcttgtttctacaaatgaaacngcctgagagcccgatcgacacgggtccgtgtattactgtgacgagagcgtcgggggacccaaggaaccgttacacgactaagcggacgttcggcggggaccaacggggaccctaccggg

SEQ ID NO: 423446 - DNA, 617 bp, Homo sapiens
  misc_feature: GZ8MTXP02GYPWU.11.25.C03.1.454.CMB.2.raw
  modified_base (405)..(405): a, c, t, g, unknown or other
  modified_base (411)..(411): a, c, t, g, unknown or other
  modified_base (425)..(425): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttggccgccaggctccgaggggaggggctgggagtgggtcttccgtttatttacgagcagtggtagtacatacttccgcagtactccggtgggacgggggcctattccaccatcnccaganacaactcaaagacncgtctgtttcttacaaatcgaacacgcctaggagagccgatcgaccgacgggtcgttagttaacttacgtggtacgcggtaacggaggtacggtccgggggacccctaaacggtaaccgtttaacgtaccgtacgtaaggtcgggaacggttccggtacgggggacccgaaaacgggggcccgtaacccggg

SEQ ID NO: 423447 - DNA, 582 bp, Homo sapiens
  misc_feature: GZ8MTXP02H91XF.11.25.C03.1.454.CMB.2.raw
  modified_base (365)..(365): a, c, t, g, unknown or other
  modified_base (377)..(377): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtgggtctcctttatttacagcagtggtagtacatattccgnagactccggtgngggggccattccaccatctccagagacaactactaaagaacacgtacttcgtttacttacaaaatgaaacagccctgagacgaccgatacgaccgacggccgttgtaacttcgtagtgacgagaggacgtcgggggacccaacggtaaaccgttactacgctaagtcgggaccgtcgtagggggacccaaaggggaccctaccgg

SEQ ID NO: 423448 - DNA, 576 bp, Homo sapiens
  misc_feature: GZ8MTXP02GF9JT.11.25.C03.1.454.CMB.2.raw
  modified_base (359)..(359): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctgagggatccgtgagccgattctctggctccaactcgtagggaacncacgccactctacgaccatccagccgggacccagggactagtggaatgacggctaggacttagttattgtacgagggcgtaggacgagcgagcacgtcgtcccgttatcgttacttcgggaaacgttcggggaacctaaacgggtcctaaacccggttccgtttaggaacgttaccgaaccggtaccccgaaaaccgggtacccctaaaaccccccg

SEQ ID NO: 423449 - DNA, 627 bp, Homo sapiens
  misc_feature: GZ8MTXP02HBIH8.11.25.C03.1.454.CMB.2.raw
  modified_base (260)..(260): a, c, t, g, unknown or other
  modified_base (365)..(365): a, c, t, g, unknown or other
  modified_base (376)..(376): a, c, t, g, unknown or other
  modified_base (390)..(390): a, c, t, g, unknown or other
  modified_base (393)..(393): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctntggggttcaccgtcagtcacacctacatgagttgggtccgccaggctccgaggggaaggggctggagtggtctcctttattacagtcagtgtagtacatatccgnagctccggtgnggggccattccacntcnccagagacaatctaaagacacgtcttcgttactacaaatgaacctaagcccttaggaacgagacccgagtacgaccgacgggcccgttagtactttacgtgtaggaccgtaaggaggtaaggtccgggggaaccccctaaacgggtaaacccggtttaacctaaccggccttaaaggtcgggtaaccggttccgggtacgggggacccctaaacgggggacccctaacccgggg

SEQ ID NO: 423450 - DNA, 554 bp, Homo sapiens
  misc_feature: GZ8MTXP02FPNSU.11.25.C03.1.454.CMB.2.raw
  modified_base (359)..(359): a, c, t, g, unknown or other
  modified_base (370)..(370): a, c, t, g, unknown or other
  modified_base (442)..(442): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgcaggctccgaggggagggctggagtgggtctcctttattacagcagtggtagtacatatccgnagactccgtgnggggccattcaccatctccagacgacaactataaagacacgtctgtttctacaaatacgaacagcctagagngaccgatcgaacacggcctgtattacgtgtgcgagagagtcgggggacccacggtaaccgttacacggtctaagttcgggacttcggcggggaccaacggggacctaccggg

SEQ ID NO: 423451 - DNA, 622 bp, Homo sapiens
  misc_feature: GZ8MTXP02JBNSG.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggcctccgaggggaggggctgggagtggtcttctttattacagcagtggtagtacatatccgcagactccggtgcgggggccattccaccatctccagagacaactctaagaacagtcttgtttactacaaaatcgaaacagtccctaggaacgacgacccgatacgaccgaccggtccgtagttacttacgtgtcgcgtaaggaggacggtacgggggaccccaaacgggtaaaccgttaaccgtaccggtacgttaacgttacggggtaaccggttccggtacgggggaccccgaaaacgggggaccccgtaaccgggg

SEQ ID NO: 423452 - DNA, 551 bp, Homo sapiens
  misc_feature: GZ8MTXP02II5BN.11.25.C03.1.454.CMB.2.raw
  modified_base (362)..(362): a, c, t, g, unknown or other
  modified_base (373)..(373): a, c, t, g, unknown or other
  modified_base (479)..(479): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaagggctggagtgggtctcctttatttacagcagtgtagtacatatccgnagactccgtgngggggccattccaccatctccagagacaaactctaaagaacacgcttgtttctacaaaatgaacagcctgagagccgatgacgacggcctgtattactgtgcgagngaagtcggggacccaacgtaacgttaactacgactaagtcggacgtcgtaggggaccaacgggacctaacgg

SEQ ID NO: 423453 - DNA, 577 bp, Homo sapiens
  misc_feature: GZ8MTXP02GEXTU.11.25.C03.1.454.CMB.2.raw
  modified_base (298)..(298): a, c, t, g, unknown or other
  modified_base (319)..(319): a, c, t, g, unknown or other
  modified_base (339)..(339): a, c, t, g, unknown or other
  modified_base (411)..(411): a, c, t, g, unknown or other
  modified_base (425)..(425): a, c, t, g, unknown or other
  modified_base (529)..(529): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtggggtgcgtctggtggagtctggaggaggcctgatccaggccgtgggggtccctgagactctcctgtgcagcctctgggttcaccgtcagtcacacctacatgagttggtccnccaggctccgagggaggggcnggagtggtctctttattacngcagtggtagtacatacttccgcagactcgtggaggggccattcacatcctcagagacaactctaaagaacngtcttgtttcctanaaatgaaacagcctgaagacgccgaatcgaaccacggggccttggttaacttacgtgtagcgaaggagaggtcgggggacccaaacggtaacgttacaaccgtntacgtcggtacgtcgggtacgggaccgaacggggacccgtacggtacc

SEQ ID NO: 423454 - DNA, 541 bp, Homo sapiens
  misc_feature: GZ8MTXP02G4AKD.11.25.C03.1.454.CMB.2.raw
  modified_base (362)..(362): a, c, t, g, unknown or other
  modified_base (373)..(373): a, c, t, g, unknown or other
  modified_base (396)..(396): a, c, t, g, unknown or other
  modified_base (464)..(464): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggaagggctggagtgggtctcctttattacagcagtgtagtacatatccgnagactccgtgnggggccattcaccatctccaganacaaactcaaagaacacgctgttctacaaatgaacagcctgagagccgatgacacggcgtgtattacngtgcgagagagtcggggcccaacgaacgttacacgctaagtcggacgttcgaggggaccaacgggggacctaccggg

SEQ ID NO: 423455 - DNA, 563 bp, Homo sapiens
  misc_feature: GZ8MTXP02GP6CW.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtgtatcaacagaagccaggccagtcccctgtattggtcatctatcaagatgtagaacgccgggccctcgagggactcccgtgacgccgtattctctcggcctaccaactcgtcgggaaacgcacgcccactctcgaaccatcgacggccgggacccaggctagtgagtgagctagtacttattagttgtgagggtcgtagggacagcgaacgcacgtcgcccgttagtcgttacgtacggaaacgttcgggaaccgtaacggtccaaccgttgtcgtaacgtccgaacgaccccaacggaccccaaaaccccg

SEQ ID NO: 423456 - DNA, 575 bp, Homo sapiens
  misc_feature: GZ8MTXP02HV8BZ.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtggttcaccgtcagtcacacctacatgagttgggtcccgcaggctccgaggggaagggctgggagtggggtcttccttttatttacgagcagtggtagtacatattccgcagactccggtgacgggggcctattccaccatcctaccagagaaccaaactctaaagaacacgtcttcgtttctacaaatgaaacagcctagagagccgatcgacacggcgtgtattacgtgtgacgagagtagtcggggaccctaagtacgttaacctacgactaagtcggacggtcgacgggtaccgacggaccgtaccgg

SEQ ID NO: 423457 - DNA, 646 bp, Homo sapiens
  misc_feature: GZ8MTXP02H71S4.11.25.C03.1.454.CMB.2.raw
  modified_base (296)..(296): a, c, t, g, unknown or other
  modified_base (389)..(389): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccacctcagtgtccgtgtccccaggacagacagccagaactccctgctctaggaatttgaaattgaagagtaataaatattacttgttaggtatacaacagaagccaggccagtcccctgtatggtnatctatacaagatagagaacgcgggccctgagggtactcccgtagacgcccgtatttccgtcgtcggctacctaacgtccgtaggggaaaccnccacgaccctactcctacgaaccctagtaccgacgggacccgggaaccccgagggtaccgtaaagtgggaagtacgggacgggtacctaggtaacgtttaatttaagttcggtacgaacggggtccggtagggacgaacgcgaacggcctaaccgtcggtaccccgtttagtcggttaccgttaccgggaaacgttcgggaacctacgggtacctaccggtcgttaggcgacgacgacccgaacggacccaaccccg

SEQ ID NO: 423458 - DNA, 551 bp, Homo sapiens
  misc_feature: GZ8MTXP02G0INF.11.25.C03.1.454.CMB.2.raw
  modified_base (361)..(361): a, c, t, g, unknown or other
  modified_base (369)..(369): a, c, t, g, unknown or other
  modified_base (387)..(387): a, c, t, g, unknown or other
  modified_base (392)..(392): a, c, t, g, unknown or other
  modified_base (408)..(408): a, c, t, g, unknown or other
  modified_base (452)..(452): a, c, t, g, unknown or other
  modified_base (459)..(459): a, c, t, g, unknown or other
  modified_base (466)..(466): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggtcaccgtcagtcacacctacatgagttggtccgcaggctccgaggggaagggctggagtgggtctcctttattacagcagtggtagtacatatccgnagactcgngcggggccatcaccatcncaganacaaactcaaagaacncgtcttgtttactacaaatgaaacagcctagagagccgatgacncggcgtntattacngtgacgtagagagtcggggaccctaacgtaacgttacaacggctaagtcgggaccgttcggagggacccgaaaggggacccacgg

SEQ ID NO: 423459 - DNA, 559 bp, Homo sapiens
  misc_feature: GZ8MTXP02G0NRL.11.25.C03.1.454.CMB.2.raw
tcagcgagagataccacgaccggtgctcgatttagtagtgtagatttgggtttgggggagaggagcccagcactgggattccgaggtgtttccattcggtgatcagcactggacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttcgggtccgccaggcctccgaggggaaggggctgggagtgggtctcctttattacagcagtgtagtacatatccgcagactccggtgacgggggccattccaccatctccagacgacaaactacaagaacacgtcttgtttctacaaatgaacagcctagagagccgatgacacggcgtgtacttcgtgtgcgagagagtcggggaccaacgtaacgtactacggctaagtcggtacgtcggtacggggaccgaacgggaccgtaccgg

SEQ ID NO: 423460 - DNA, 573 bp, Homo sapiens
  misc_feature: GZ8MTXP02GQ29Z.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgaggttcgggtccgccaggctccgaggggaagggctggagtggtctcctttattacagcagtggtagtacatactccgcagactccgtggcgggggccattcaccatctccagagacaaactctaaagaacacgcttgtttacttacaaatcgaacagcctagagagccgatcgacgacggccgtgtaacttctggtcgcgagaggagtccggggacccaacggtaacgttaccgacgtctaagtcggaccgtcgtacgggggaccaaacgggggaccctaccggg

SEQ ID NO: 423461 - DNA, 703 bp, Homo sapiens
  misc_feature: GZ8MTXP02IE4HM.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtcgtggtggagtcgtgggaggaggcctgatccagccgtgggggtccctgacgactctcctgtcgcacgcctcgtcgggttcaccgtcagtcaccacctacagtgaggttcggtccgccgaggcctaccggagggggaagggctgggaggtggttcttccttttaattacagcgtaaggtggtaagtacacttacgttcccgacacggacctccggtggacgggggccctattccacctactctacagaacgtaacaacttacaaacgaaccacgtctttcgtttactaacaaagtcgaaacacggtacctaggaacggacggacccgtagtacggaacccgtaccgggtaccgtttaggttaaacgtttacgtgggtacggaccggaaggtaacgggtacgggttcggggaaaccccctaaacggttaacccgttaacgtaccgtacgttaacggtacgggtaccgttcgggacggggaccccgaaaacggggtacccgtaacccggg

SEQ ID NO: 423462 - DNA, 571 bp, Homo sapiens
  misc_feature: GZ8MTXP02HH17Y.11.25.C03.1.454.CMB.2.raw
  modified_base (298)..(298): a, c, t, g, unknown or other
  modified_base (304)..(304): a, c, t, g, unknown or other
  modified_base (337)..(337): a, c, t, g, unknown or other
  modified_base (356)..(356): a, c, t, g, unknown or other
  modified_base (364)..(364): a, c, t, g, unknown or other
  modified_base (366)..(366): a, c, t, g, unknown or other
  modified_base (381)..(381): a, c, t, g, unknown or other
  modified_base (386)..(386): a, c, t, g, unknown or other
  modified_base (409)..(409): a, c, t, g, unknown or other
  modified_base (443)..(443): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctggaggaggcctgatccagccgtgggggtccctgagactctcctgtgcagcctctggggttcaccgtcagtcacacctacatgagtggccncaggcncgaggggagggctggagtggtctctttattacngcagtgtatacatatccgnagactcgngnggggccatcacatcncaganacaactctaaagaaccacgtctntttactaacaaaatgaaacagcctagagacgcancgaacacggcgtagttacttacgtgtacgacgaagagtacgtcgggggaccccaaacggtaaaccgttactaacggctaaggtcggaaccgttcgggacggggaccgaaaacgggtacccaacccggg

SEQ ID NO: 423463 - DNA, 544 bp, Homo sapiens
  misc_feature: GZ8MTXP02HSAB9.11.25.C03.1.454.CMB.2.raw
  modified_base (299)..(299): a, c, t, g, unknown or other
  modified_base (319)..(319): a, c, t, g, unknown or other
  modified_base (341)..(341): a, c, t, g, unknown or other
  modified_base (362)..(362): a, c, t, g, unknown or other
  modified_base (372)..(372): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccnccaggctccgagggagggcnggagtggtctcctttatttacngcagtggtatacatattccgnacgactccgngacgggggccattcaccatctaccagagacaactcaaagacacgcttgtttctacaaatgaacagcctagacgtagccatacgacacggccgtagtacttacgtgtgcgagagagtcgggacccaacgacgttacacgctaagcggacgtcgcgggaccaagggacccacgg

SEQ ID NO: 423464 - DNA, 599 bp, Homo sapiens
  misc_feature: GZ8MTXP02GTXLE.11.25.C03.1.454.CMB.2.raw
  modified_base (364)..(364): a, c, t, g, unknown or other
  modified_base (374)..(374): a, c, t, g, unknown or other
  modified_base (395)..(395): a, c, t, g, unknown or other
  modified_base (571)..(571): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggaagggctggagtgggtcttcctttattacagcagtggtagtacatatccgnagactcgtgnggggccgattcaccatctcanagacaaacttcaaagaacacgtcttgtttacttacaaaatgaaactagcctagagaggcccgaagtcgaaacgaccgggtaccgttagtaatttacgtgtacgcggaaaggtagaaggttccgggggaccccaaacgtaaacgttaacgtacggacttaagcggaaccggttccgngggggacccaaaacggggcccaacccgg

SEQ ID NO: 423465 - DNA, 541 bp, Homo sapiens
  misc_feature: GZ8MTXP02JJLVS.11.25.C03.1.454.CMB.2.raw
  modified_base (376)..(376): a, c, t, g, unknown or other
  modified_base (470)..(470): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccaggggaagggctgggagtgggtctcctttatttacagcagtggtagtacatattccgcagactccgtgngggggccattcaccatctccagagacaactctaaagaacagctgtttcttacaaatgaacagcctgagagccgatgacacggccgtgtattacngtgcgagagatcgggggcccacggaacgttacacgctaagtggacgtcgtcgggaccaaggggacctacgg

SEQ ID NO: 423466 - DNA, 633 bp, Homo sapiens
  misc_feature: GZ8MTXP02I67E3.11.25.C03.1.454.CMB.2.raw
  modified_base (362)..(362): a, c, t, g, unknown or other
  modified_base (399)..(399): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctctgggttcaccgtcagtcacacctacatggagttgggccgccaggctccgaggggaagggctggagtgggtctcctttattacagcagtgtagtacatatccgnacgactccgtgcgggggccgattcaccatctccaganacaaactctaaagaacactacttgtttacttcaaaatcgaaacagccctaggaagtacgacccggatcgaacccgacgggcccgttaggttaatttaccgtggtaggccggaaaggaagggtacggtcgggggaacccccaaaggtaaacccgtttaacgtaaccgacgtttaacggtacgggtaaccggttcgtacggggggaccctaaaacgggggaccctaaacccggggg

SEQ ID NO: 423467 - DNA, 515 bp, Homo sapiens
  misc_feature: GZ8MTXP02GOFC8.11.25.C03.1.454.CMB.2.raw
  modified_base (265)..(265): a, c, t, g, unknown or other
  modified_base (461)..(461): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtggtatcaacagaanccaggccagtcccctgtatggtcatctatcaagatgtgaagcggccctcagggactccctgagccgtattctctcggctccaactcgtagggaacgcagccactctgacccatccagccgggacccagctatgatgaggctagacttattattgtcaggcgtggacagcagcactgcccgttatgtcttcggaacncggaccaagggtccaccgtgttcgacgtcgacgacccgaacggcccaaaccccg

SEQ ID NO: 423468 - DNA, 606 bp, Homo sapiens
  misc_feature: GZ8MTXP02JOTDF.11.25.C03.1.454.CMB.2.raw
  modified_base (362)..(362): a, c, t, g, unknown or other
  modified_base (370)..(370): a, c, t, g, unknown or other
  modified_base (383)..(383): a, c, t, g, unknown or other
  modified_base (386)..(386): a, c, t, g, unknown or other
  modified_base (390)..(390): a, c, t, g, unknown or other
  modified_base (405)..(405): a, c, t, g, unknown or other
  modified_base (409)..(409): a, c, t, g, unknown or other
  modified_base (419)..(419): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgaggttcggccgccaggcctccgaggggagggcgtggagtggtctcctttattacagcagtgtatacatactcgnagactcgngcgggcatccacntcnccanagacaatcaaagacncgtnttgttctaanaatacgaacagcaggacgacgaccgagtacgaccgaccggtcgttagtacttcgtggcgaacggacggaacggtacgggtacccgggggaaacccctaaacgggtaaaccgttaccgtacgtacgttaacgggtacgggtaccggtacggggacggggaacccggaaaccggggtaccccgtacggg

SEQ ID NO: 423469 - DNA, 569 bp, Homo sapiens
  misc_feature: GZ8MTXP02FXABG.11.25.C03.1.454.CMB.2.raw
  modified_base (275)..(275): a, c, t, g, unknown or other
  modified_base (368)..(368): a, c, t, g, unknown or other
  modified_base (379)..(379): a, c, t, g, unknown or other
  modified_base (397)..(397): a, c, t, g, unknown or other
  modified_base (491)..(491): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggtcaccgtnagtcacacctacatgagttgggtccgccaggctccgaggggaagggctggagtgggtcttcctttattacagcagtggtagtacatattccgnagactccgtgngggggccattcaccatcnccagagacaactctaaagaacacgtcttgtttctacaaatcgaaacagcctagacgagcccgaatcgaaccacgggtcccgttgtaatttacgngtcgacgagagagtcgggggacccaacggtaacgttacacgctaagtgggactcggtggggaccaaggggacccacgg

SEQ ID NO: 423470 - DNA, 583 bp, Homo sapiens
  misc_feature: GZ8MTXP02IDYJ5.11.25.C03.1.454.CMB.2.raw
  modified_base (377)..(377): a, c, t, g, unknown or other
  modified_base (397)..(397): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccaggctccgaggggacgggctgggagtggtctcctttatttacagcagtggtatacatatccgcagactccgtgngggggcctattccactatcnccagatacaacttcaaagaacacgcttgtttactacaaaatcgaaacaggccttaggacgaagcccgatgaccgacggtccgttagtattacctggtgacggagacgaggtcgggacccaaacggtaccgttacacgtcgtaagtcggaacgttcggacggggaccgaaacgggtacccgacccgg

SEQ ID NO: 423471 - DNA, 547 bp, Homo sapiens
  misc_feature: GZ8MTXP02I28I5.11.25.C03.1.454.CMB.2.raw
  modified_base (363)..(363): a, c, t, g, unknown or other
  modified_base (374)..(374): a, c, t, g, unknown or other
  modified_base (475)..(475): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggggttcaccgtcagtcacacctacatgagttggtccgccaggctccgaggggaagggctggagtgggtctcctttattacagcagtggtagtacatattccgnagactccgtgnggggccattcaccatctccagagacaactctaaagaacacgcttgtttacttacaaatgaaactagcctgagagccgatcgacgacggcctagtacttacngtgcgagagagtcggggacccaacgacgttacacgctaagtcggacgttcgaggggaccaaggggaccacgg

SEQ ID NO: 423472 - DNA, 560 bp, Homo sapiens
  misc_feature: GZ8MTXP02HMB4H.11.25.C03.1.454.CMB.2.raw
  modified_base (475)..(475): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggagggctggagtgggtctcctttatttacagcagtggtagtacatatccgcagactccgtgacgggggccattccaccatctccagagacaactctaaagacacgcttgtttctacaaatcgaaacagcctgaagagccgatcgacacggccgtgtattacgngtgcgtagagagtcggggaccctaacggaacgttactaacggctaagtcggacgtcggtacggggacccaaggggtaccaccggg

SEQ ID NO: 423473 - DNA, 543 bp, Homo sapiens
  misc_feature: GZ8MTXP02JZ7BG.11.25.C03.1.454.CMB.2.raw
  modified_base (376)..(376): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggggttcaccgtcagtcacacctacatgagttgggtccgccaggctccaggggaagggctggagtgggtctcctttatttacagcagtggtagtacatattccgcagactccgtgnggggccgattcaccatctccagagacaaactctaaagaacacgactgtttcttcaaatgaaacagcctgagagccgatgacacggcgtgtatactgtgcgagagatcgggggcccacggaacgttactacgctaagtcggacgtcgtggggaccaacgggaccacgg

SEQ ID NO: 423474 - DNA, 557 bp, Homo sapiens
  misc_feature: GZ8MTXP02I0X4R.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactccctgctctggaattgaattgagagataaatatacttgttggtatcaacagaagccaggccacgtcccctgtattgtcatctatacaagatgtgaacgcggccctcgagggactcccgtgagccgtattctcgtcggctaccaactcgtacgggaacgcacgccactctcgaccatcgacgccgggacccagactagtgatggacgcgtagtacttattagttgtacgagggtcgtaggacgagcgaagcacgtcgtccgttatcgttacgtacggaacgtacgggtaaccgaacggtccaaccggttcgtacggacgtacacgacccgaacggaccccaaacccg

SEQ ID NO: 423475 - DNA, 570 bp, Homo sapiens
  misc_feature: GZ8MTXP02HQ6P2.11.25.C03.1.454.CMB.2.raw
  modified_base (156)..(156): a, c, t, g, unknown or other
  modified_base (188)..(188): a, c, t, g, unknown or other
  modified_base (256)..(256): a, c, t, g, unknown or other
  modified_base (261)..(261): a, c, t, g, unknown or other
  modified_base (263)..(263): a, c, t, g, unknown or other
  modified_base (298)..(298): a, c, t, g, unknown or other
  modified_base (323)..(323): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtntaggctattaaagagtcagtgtgaggtgcgtntggtggatctggaggaggcctgatccagccgtggggggtccctgagctctcctgtgcagctctggtcncgtcncncacacacatgtgtcggtcgcgagcgcgagggaggngtggtggtgtcttcttattactagngtagtgtagtactactactcgcacgtacgtcgtggcgggcgtactcactactctacacgacgactaactactaacgaacgtacgtacgttcgttacttactaactacgtaacgacgacgtacgacgacgacgtacgtacgacgtacgtacgtacgtacgtacgtgtgacgacgagacggtacggaccgtaacgtacgtacgtacgtacgtaacgtcgtacggtcggtacggacggacggtacgtacg

SEQ ID NO: 423476 - DNA, 567 bp, Homo sapiens
  misc_feature: GZ8MTXP02JKYES.11.25.C03.1.454.CMB.2.raw
  modified_base (198)..(198): a, c, t, g, unknown or other
tcagcgagagataccacgaccggtgctcgatttagtagtgtagatttgggtttggggctgggcctcaggaagcagcatcggtggtgcctcagccatggcatggatccctctcttcctcggcgtccttgcttactgcacaggattcgtggcctccgatgagttgactcagcccaccctccatgtccgtgtcccccgganagacagccaccatcagctgctctggagatgtcttgactaatgagtatgcttcctggtatcagcaggaaggcacggccacgccccctgtcctactcactcttacaaaataccaggccgcctcgtcggggtccctgacgccgtacttccgtaccggtcctccggcttcgtcggggaaacacgacgtcactctacgacactcacgccggaccaggctatcgagtgacgctgtcttacttctgtcagggcgtacgggaacacgaggtcggtggtcgggttcggcggggacggtaccgaggtccgtcggtaccgttcgttacgccgacgtcccgaacggtcctccggtccccgtcggtcctacctcgttccccg

SEQ ID NO: 423477 - DNA, 655 bp, Homo sapiens
  misc_feature: GZ8MTXP02IPJIA.11.25.C03.1.454.CMB.2.raw
  modified_base (299)..(299): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgatccagccgtgggggtccctgagactctcctgtgcagcctcgtgggttcaccgtcagtcacacttacatgaggttcgggtccnccgaggcctccggaggggaaggggctgggaggtgggtcttcctttattacagcagtgtagtacatactccgcagactccggtggacgggggcctattccacctactcctaccgaagaacgaactaaacgtcaaaacggaccacgtctttacgtttactaacgaaaatcgaaacacgtacctaggaacgacgaccgtaatacggaccgaacgggtccgttagttaacgttacgtggtacgacggtaacggaggtacggtaccgggggaacccaaacggttaaaccggttacctaacggtacttaaaggtcgggaaccgttcggacgggggacccaaacgggggaccctaaaccgggg

SEQ ID NO: 423478 - DNA, 567 bp, Homo sapiens
  misc_feature: GZ8MTXP02I4GFF.11.25.C03.1.454.CMB.2.raw
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactccctgctctggaattgaattgagagataaatatacttgttggtatcaacagaagccaggccagtcccctgtattggcatctatcaagatgtagaagccggccctagagggactcccgtagagccgtattctctcggctaccaactcgtagggaactcacgccactctcgaccatccgacggaccgggacccagactagtggacgtgacggctaggacttagttagttgtcgagggcgtaggacagcagcacgtcgacccgtttatcgttcgtaccggaaacgttcggggaacctaaacggtccaaccggttcgttacggacgtaccgacgaccccgaaacggaccccctaaaccccg

SEQ ID NO: 423479 - DNA, 534 bp, Homo sapiens
  misc_feature: GZ8MTXP02F917P.11.25.C03.1.454.CMB.2.raw
  modified_base (363)..(363): a, c, t, g, unknown or other
  modified_base (445)..(445): a, c, t, g, unknown or other
  modified_base (471)..(471): a, c, t, g, unknown or other
  modified_base (477)..(477): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcctgttagctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaagggctggagtgggtctcctttattacagcagtggtagtacatacttccgnagactccggtgcgggggccattcaccatctccagacgacaaactctaaagacacgctgtttctacaaatgaaacagcctgangccatcgacacggctgtaactctggngagagngagcggaccacgtacgtacacgctaagtcggacgtcggacggacgaacggacctacg

SEQ ID NO: 423480 - DNA, 563 bp, Homo sapiens
  misc_feature: GZ8MTXP02FKHQ7.11.25.C03.1.454.CMB.2.raw
  modified_base (300)..(300): a, c, t, g, unknown or other
  modified_base (442)..(442): a, c, t, g, unknown or other
  modified_base (466)..(466): a, c, t, g, unknown or other
  modified_base (472)..(472): a, c, t, g, unknown or other
  modified_base (480)..(480): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggtcaccgtcagtcacacctacatgagttgggtccnccaggctccgaggggagggctggagtggtctcctttattacagcagtggtagtacatacttccgcagactccggtggagggggcccattcacccatctccagagacaaactctaaagacacgtctgtttctacaaatgaacngcctgagagccatgacacggcgtntatacngtcgcganagagtcgggggacccaacggtaacgttaccacgactaagtcggggaccgtcggtacgggggaccaaacggggccctaaccggg

SEQ ID NO: 423481 - DNA, 638 bp, Homo sapiens
  misc_feature: GZ8MTXP02HX2VQ.11.25.C03.1.454.CMB.2.raw
  modified_base (191)..(191): a, c, t, g, unknown or other
  modified_base (251)..(251): a, c, t, g, unknown or other
  modified_base (309)..(309): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcggtggtttcgtgtaggctatttaaagagtcagtgtgaggtgcgtntggtggagtctgggaggaggcctgatccagccgtggggggtcctgagactctcctgtgcncgctcgtcgtcacgtcactcacactacatgtagtcggtcgcgagcgacggagggaggngtggaggtggtcgttactttattactagagtagtagtagtactactactacgacgacgtacgtcggtcgggcgggtacgtactacctacctactactacacgaacaactaactaactaaacgaacgtacgtacgttacgtttacttaactaaacgtacgaacgtacgtacgtacgtacgtacgacgacgtacgtaacggaccggtacgttacgttagttagtagtagacggtacggaggtacggtaccggtaccgtaaacgtaacgtaacgtaacgtacgtaacgtacggtacggtacggtacgggaaccggaaccggtaccggtaccg

SEQ ID NO: 423482 - DNA, 554 bp, Homo sapiens
  misc_feature: GZ8MTXP02JNW1H.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtgggtctcctttattacagcagtggtagtacatatccgcagactccggtgagggggccattccaccatctccagagacaactctaaagacacgctgtttctacaaatgaaacagcctgacgagccgatgaccacgggcctgtacttacgtgtgcgagagagtcgggggcccaacgtaacgttactacgctaagtcggaacgtcgtacggggaccaacggggacctaccgg

SEQ ID NO: 423483 - DNA, 560 bp, Homo sapiens
  misc_feature: GZ8MTXP02HPBSF.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccatcagtcacacctacatgagttgggtccgccaggctccgagggaaggggctggagtgggtctccttttatttacagcagtggtagtaccatattccgcagaccttccgtggaggggccgattccaccatctccagagacaactctaaagaacacgcttgtttcttacaaaattgaaacagcctagagagccgaatgactacgggccgtgtattacgtgtgcgaggagacgtgggggacccacggacgttacctagcctaagtcggacgtcgtcggggaccaacgggacccg

SEQ ID NO: 423484 - DNA, 560 bp, Homo sapiens
  misc_feature: GZ8MTXP02IHBZR.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcagcctctgggttcaccgtcagtcacacctacatgagttggtccgccaggctccgaggggaagggctggagtgggtctcctttattacagcagtggtagtacatattccgcagactccggtgacgggggccattcaccatctccagacgacaactactaaagaacacgtcttgtttctacaaaatgaacagcctagagagccgatgacgacggcgtagtacttactgtagcgagagagtcggggacccaacgtaacgttaactacgactaagtcggaacgtcgtaggggaccaaacggggaccaccgg

SEQ ID NO: 423485 - DNA, 533 bp, Homo sapiens
  misc_feature: GZ8MTXP02I4LVJ.11.25.C03.1.454.CMB.2.raw
  modified_base (298)..(298): a, c, t, g, unknown or other
  modified_base (402)..(402): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtcccaggacagacagccagaactcccctgctctggaattgaattgagagataaatatacttgttggtatcaacagaagccaggccagtcccctgtatggtcatctatcaanatgtgaagccggccctcgacgggactccccgtgacgccgtattctctcggctccaactcgtgggaaacgcacgccactctgaccatcagcggacccaggctagnggatgagctagacttattatgtcgagggcgtgggacagcagcacgtcgtcccgttatcgtcgtcggaacgttcgggacctaacggcaaccgttgtcggtacgtcgacgacccgaacggaccctaaaccccg

SEQ ID NO: 423486 - DNA, 637 bp, Homo sapiens
  misc_feature: GZ8MTXP02IYEWU.11.25.C03.1.454.CMB.2.raw
  modified_base (255)..(255): a, c, t, g, unknown or other
tcagcgagagataccacgaccggtgctcgatttagtagtgtagatttgggtttgggggagaggagtccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccgagccggtcgggggtcctgagactctctgtgcngcctcgtggtcacgtcagtcacacctacatgagttcggccgccgaggcctccgaggggaggcgtgggagtcggtcttctttattacagcgtagtgtagtacatactccgcacgctccggtgggcgggggcctactccacctgtccaccagacgaaccaaactactaaacgaactcgtctttcgtttactaacaaaagtcgaaacacgtcctaggacgacgtacccgaagtcgaaccgtaccgggtacctttagttaactttacgtggtacgacggtaagacggtacgggtaccgggaacccctaaggttaaacccgttacgtaaccgtagtaacggttacggacggttcggacggggacccgaacgggtaaccccgtaccgg

SEQ ID NO: 423487 - DNA, 619 bp, Homo sapiens
  misc_feature: GZ8MTXP02GW6R4.11.25.C03.1.454.CMB.2.raw
  modified_base (339)..(339): a, c, t, g, unknown or other
  modified_base (359)..(359): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgagttggccgcaggctcgaggggagggctggagtggtctctttattacngcagtggtatacatatccgnagactccggtggacgggggcctatccacctatcctacagacaacaactactaaagaacacgtcttgtttactaacaaatcgaaacagcctagacggacgccagtacgaaccgtacgggtccgttagtaacttacgtggtagacggtaagacggtacggtaccgggggacccctaaacggtaaaccgtttaccgtacgtcgttaaacggtcgggtaaccggttcggacgggggaacccgaaacggggacccgtaacccggg

SEQ ID NO: 423488 - DNA, 528 bp, Homo sapiens
  misc_feature: GZ8MTXP02FQ2GS.11.25.C03.1.454.CMB.2.raw
  modified_base (358)..(358): a, c, t, g, unknown or other
tcagcgagagataccacgaccggtgctcgatttagtagtgtagatttgggtttgggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcgagggatccctgagcgattctctcggctccaactcgtgggaacncagccactctgaccatcagcgggacccaggctagtggatgagctagactattatgtcgagggcgtagggacaggcagcacgtcgcccgttatcgttacgttcgggaaactcgggaacctaacgggtccaaccgttgttcgacgtacacgacccaacggacccaaaccccg

SEQ ID NO: 423489 - DNA, 574 bp, Homo sapiens
  misc_feature: GZ8MTXP02IEPOL.11.25.C03.1.454.CMB.2.raw
  modified_base (377)..(377): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtgggtctcctttattacagcagtggtagtacatattccgcagactccgtggngggggccattccaccatctccagacgacaactctaagaacacgtctgtttcttacaaatcgaacagcctaggagacgccgatcgaccgacggccgtgtaacttacgtgtgcgtagagagtcgggggacccaacggtaaccgttactcgactaagtcgggacgtcggtacggggaccgaaacggggaccctaaccggg

SEQ ID NO: 423490 - DNA, 587 bp, Homo sapiens
  misc_feature: GZ8MTXP02F5W1W.11.25.C03.1.454.CMB.2.raw
  modified_base (361)..(361): a, c, t, g, unknown or other
  modified_base (388)..(388): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggagggctggagtgggtctctttattacagcagtgtagtacatatccgnagactccgtgcggggcattcaccatcncagacgacaactcaaagacacgtctgtttactacaaatgaacagcctagagagccgatcgaacaccgggccgttgtaacttacgtgtgacggtaggacggagtccgggggacccctaaacggtaaccgtttaaccgacgacgttaaggtacgggaccgttcggtacgggggacccaaaacgggggacccctaaccgggg

SEQ ID NO: 423491 - DNA, 588 bp, Homo sapiens
  misc_feature: GZ8MTXP02HGHHM.11.25.C03.1.454.CMB.2.raw
  modified_base (363)..(363): a, c, t, g, unknown or other
  modified_base (375)..(375): a, c, t, g, unknown or other
  modified_base (391)..(391): a, c, t, g, unknown or other
  modified_base (396)..(396): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttggtccgccaggctccgaggggagggctggagtgggtctcctttatttacagcagtggtagtacatatccgnagactccgtggnggggccatccacatcncaganacaactcaaagacacgtctgtttctacaaatgaaacagcctagagagccgatcgacgaccgggtccgtagtacttacgtggtacgacggaagagacggtccgggggaccctaaacgggtaaaccgttacgtacggactaaggtcgggaaccggttcggacgggggacccaaaacgggggaccctaaccgggg

SEQ ID NO: 423492 - DNA, 565 bp, Homo sapiens
  misc_feature: GZ8MTXP02JD534.11.25.C03.1.454.CMB.2.raw
  modified_base (365)..(365): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgcaggctccgaggggaagggctgggagtgggtctcctttatttacagcagtggtagtacatattccgnagactccgtgcgggggccattccaccatctccagagacaactcaaagacacgctgtttcttacaaatgaacagcctggacgagccgatcgacacggccgtgtattacgtgtgcgaaggacgagtcggggacccaaacggtaccgttaacgtacgactaagtcggaacgtcggtacggggaccaacggggacccgtacggg

SEQ ID NO: 423493 - DNA, 537 bp, Homo sapiens
  misc_feature: GZ8MTXP02F75E4.11.25.C03.1.454.CMB.2.raw
  modified_base (339)..(339): a, c, t, g, unknown or other
  modified_base (358)..(358): a, c, t, g, unknown or other
  modified_base (379)..(379): a, c, t, g, unknown or other
  modified_base (382)..(382): a, c, t, g, unknown or other
  modified_base (385)..(385): a, c, t, g, unknown or other
  modified_base (387)..(387): a, c, t, g, unknown or other
  modified_base (393)..(393): a, c, t, g, unknown or other
  modified_base (453)..(453): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttggccgcagctccgaggggaagggctggagtggtcttctttattacngcagtgtatacatatccgnagactcgtgcggggcatcacntcncananacactnaaagacacgtctgtttctacaaatgaacagcctagagagcgatgacacggctagtatacngtgcgagagagtcggggacccaaaggtacgttacacgactaagtcggaacgttcgacgggggacctaacggggaccaacccggg

SEQ ID NO: 423494 - DNA, 604 bp, Homo sapiens
  misc_feature: GZ8MTXP02H6NLE.11.25.C03.1.454.CMB.2.raw
  modified_base (344)..(344): a, c, t, g, unknown or other
  modified_base (355)..(355): a, c, t, g, unknown or other
  modified_base (364)..(364): a, c, t, g, unknown or other
  modified_base (371)..(371): a, c, t, g, unknown or other
  modified_base (390)..(390): a, c, t, g, unknown or other
  modified_base (416)..(416): a, c, t, g, unknown or other
  modified_base (433)..(433): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtggggttcaccgtcagtcaacacctacatgaggttggccgccaggctccgaggggagggctggagtggtcttctttattacngcagtgtatanatattccgnagctcgnggcgggccatcaccatccncaagacgaaccaatacgtaaagaacncgtctttgttacttaanaaaagtgaaaacctagccctaggaacgtacgccgaagtcgaacgaccggccgtagtactttacgtggtacgacggagaggtacggtacggggtacccccaaacggtaaaccgttaccaacggcttaagcggtaaccggttcggacggggaccaaaacggggccctaaccgg

SEQ ID NO: 423495 - DNA, 582 bp, Homo sapiens
  misc_feature: GZ8MTXP02JPEBJ.11.25.C03.1.454.CMB.2.raw
  modified_base (363)..(363): a, c, t, g, unknown or other
  modified_base (380)..(380): a, c, t, g, unknown or other
  modified_base (565)..(565): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtccgtgtccccaggacagacagccagaactcccctgctctggagatgtcttgactaatgagtatgcttcctggtatcagcagaaggcaggccacgccccctgtcctactcatcttacaaaatccaggccgcctgtcgggtccctgacgcgacttcgccggctccggctcgtagggaccacngtccacgtctacgaccntcgacgccgggacccaggcctagttagagtaggacggtcttacgtacttaccgttcgtgttccgagggcgtacggggaacaacgaggcggttgggtcggttcggggcgggaacgggaccgtaggtcgtacggaacccgtcgttacgggtccacggcccgaaggtccgtccgccccggtcggtacnccttcctcgtttccccc

SEQ ID NO: 423496 - DNA, 611 bp, Homo sapiens
  misc_feature: GZ8MTXP02F39TY.11.25.C03.1.454.CMB.2.raw
  modified_base (353)..(353): a, c, t, g, unknown or other
  modified_base (375)..(375): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggtcaccgtcagtcacacctacatggtaggttgggtcccgccaggcctccgagggggaaggggctgggagtgggtctcctttattacngcagtgtagtactatactccgnagtactccggtggcgggggccaattccacctatcctcagacacaaactcaaagaacacgtcttgtttactacaaatgaacagcctgagcgaccgagtcgaaccgacggtccgttgttaacttacgtggtgaccggaagtacggacggtccgggggacccctaaggtaaacccgttacgtacggacttaagtcgggtaccgtcggtacgggggacctaaacgggggccctaaccggg

SEQ ID NO: 423497 - DNA, 560 bp, Homo sapiens
  misc_feature: GZ8MTXP02FP3WH.11.25.C03.1.454.CMB.2.raw
  modified_base (361)..(361): a, c, t, g, unknown or other
  modified_base (372)..(372): a, c, t, g, unknown or other
  modified_base (389)..(389): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtggtctctttattacagcagtgtagtacatattccgnagactccgtgnggggccattcaccatcncagagacaactctaaagaacacgctgtttctacaaatgaacagcctgagagccgatgaacacggccgtgttatactgtgacgagagagtcgggggacccaacggtaaacgttacgtacgacgtaagtcgggaaccgtcggtacggggaccgaacggggacccgtaaccggg

SEQ ID NO: 423498 - DNA, 692 bp, Homo sapiens
  misc_feature: GZ8MTXP02F3NH2.11.25.C03.1.454.CMB.2.raw
  modified_base (366)..(366): a, c, t, g, unknown or other
  modified_base (375)..(375): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccgaggctccgaggggagggctggagtggtctcctttattacagcagtgtagtacatatccgnagctccggnggcggggccattcacctatcctaccagagacaaactctaaagaaccacgtcttgtttctacaaagtgaaacagaccctaggaagacggacccgtagtacggaacccgtaccggggtcccgttaagttaactttaaccgtgggttacggaccgggaaaacgggtaaggtaacgggttaccggggggaaccccctaaaacggggttaaaaccccgggttttaaccgtaaaccggtccgttaaaaggttcgggggtaaaccgggtttccgggaaccgggggggtaaccccaaaacggggggaccccttaaaccccggggg

SEQ ID NO: 423499 - DNA, 593 bp, Homo sapiens
  misc_feature: GZ8MTXP02IP02T.11.25.C03.1.454.CMB.2.raw
  modified_base (345)..(345): a, c, t, g, unknown or other
  modified_base (366)..(366): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctgggaggaggcctgatccagccgtggggggtccctgagactctcctgtgcagcctcgtgggttcaccgtcagtcacacctacatgagttgggtccgccaggctccgaggggaggggctggagtgggtctctttattacngcagtgtagtacatattccgnagactccggtggagggggccattcaccatctccagagacaacttcaaagacacgcttcgtttactacaaaatcgaaacagcctaggagacgacccgatcgaaccgacgggaccgttgtaacttacgtgtcgacgtaggagaggtccgggggacccaacggtaaacgttacctacgtacgtaagtcgggaaccgtcggtagggggacccgaacggggacccgtaccgg

SEQ ID NO: 423500 - DNA, 641 bp, Homo sapiens
  misc_feature: GZ8MTXP02I5G3A.11.25.C03.1.454.CMB.2.raw
  modified_base (378)..(378): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtggttcaccgtcagtcacacctacatgagttgggtccgccaggctccgaggggaagggctggagtgggtcttcctttatttacagcagtggtagtacatattccgcagtactccgtgngggggccattcaccatctccagacacaactctaaagaacacgtcttgtttcttacaaatgaacagtccctagacgtacgacccgatacgaaccgacgggtccgttaggttaacttaccgtaggtaggtacggaaggtaggtaaacggttccgggggaaccccctaaacggtaaaccgtttaaaccgtaccgtacgttaacggtcgggtaacccggttacggtcgggggaacccgaaaacgggggtaccccgtaaacccggggg

SEQ ID NO: 423501 - DNA, 611 bp, Homo sapiens
  misc_feature: GZ8MTXP02IQ3ZI.11.25.C03.1.454.CMB.2.raw
  modified_base (298)..(298): a, c, t, g, unknown or other
  modified_base (361)..(361): a, c, t, g, unknown or other
  modified_base (390)..(390): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttgggccnccaggctccgaggggaagggctggagtggtctcctttattacagcagtgtagtacatatccgnacgactccgtgcggggccatccaccatcncagacgacaactcaaagaacacgtcttgtttactacaaaatgaaacagcctaggacgacgaccgatacgaaccgaccgggtcgttagttaacttaacgtggtacgacggaaaggacggtaacggtccgggggaaacccctaaacggtaaaaccgtttaaccgacgtacgtaacgtacgggaacgttcggacggggacccgaaaacggggaccctaaccggg

SEQ ID NO: 423502 - DNA, 524 bp, Homo sapiens
  misc_feature: GZ8MTXP02G4W8W.11.25.C03.1.454.CMB.2.raw
  modified_base (177)..(177): a, c, t, g, unknown or other
  modified_base (368)..(368): a, c, t, g, unknown or other
  modified_base (438)..(438): a, c, t, g, unknown or other
  modified_base (467)..(467): a, c, t, g, unknown or other
  modified_base (498)..(498): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtgtccgtgtccccaggacagacagccagaactcccctgctctggaattgaattgagagataaatatacttgttggtatcaacagaagccaggccagtcccctgtatggtcatctatcaagatgtagaagccggccctcgagggactccctggacgccgattctctggctaccaactcgtagggaaaccncgacgccactctacgacccatacacgccgggaacccaggctagtggatggagctagacttattattgtcngggtcgtggacagcagcagtcgccgttancgtcgttcggaacgtcggaccacgtcacgtntgacgtcagacccacggcccaacccg

SEQ ID NO: 423503 - DNA, 594 bp, Homo sapiens
  misc_feature: GZ8MTXP02IH8SA.11.25.C03.1.454.CMB.2.raw
  modified_base (363)..(363): a, c, t, g, unknown or other
  modified_base (448)..(448): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggttcaccgtcagtcacacctacatgagttcggccgcaggctccgaggggagggctggagtggtctctttattacagcagtggtagtacatactccgnagactccgtgcgggggcctattccaccatcctaccagacaacaaactactaaagaacacgtcttgtttacttacaaaatgaaacngcctagagacgccgatcgacacggccgtagtacttacgtgtagacgaggaacgacggtaccggggacccctaaacggtaaaccgtttaccaacggacttaaggtcggacggttccggacggggacccgaaacgggaccctaccggg

SEQ ID NO: 423504 - DNA, 569 bp, Homo sapiens
  misc_feature: GZ8MTXP02GMQEI.11.25.C03.1.454.CMB.2.raw
  modified_base (298)..(298): a, c, t, g, unknown or other
  modified_base (316)..(316): a, c, t, g, unknown or other
  modified_base (337)..(337): a, c, t, g, unknown or other
  modified_base (358)..(358): a, c, t, g, unknown or other
  modified_base (365)..(365): a, c, t, g, unknown or other
  modified_base (383)..(383): a, c, t, g, unknown or other
  modified_base (404)..(404): a, c, t, g, unknown or other
  modified_base (407)..(407): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtcgtggaggaggcctgatccagccgtggggggtcctgagactctcctgtgcagcctcgtgggttcaccgtcagtcacacctacatgagttggtcncaggctcgagggagggcnggagtgggtctctttattacngcagtggtatacatactccgnagctcgngacggggccatcacatcncagacacaactacaaagaacnctntctttctacaaatagaactagcctaggagagccgatcgaacgacggccgttagtaacttcgagtcgacgtaggacgtaggtacggggaccccaacggtaaccgttacgacgtactaagtcggaacggttcggaccggggaccgaaacggggtaccctaacgg

SEQ ID NO: 423505 - DNA, 597 bp, Homo sapiens
  misc_feature: GZ8MTXP02F3XED.11.25.C03.1.454.CMB.2.raw
  modified_base (341)..(341): a, c, t, g, unknown or other
  modified_base (361)..(361): a, c, t, g, unknown or other
  modified_base (371)..(371): a, c, t, g, unknown or other
  modified_base (391)..(391): a, c, t, g, unknown or other
  modified_base (458)..(458): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggaaggggctggagtggtctctttattacngcagtgtagtacatatccgnagactccggngcgggggccattcaccatcnccagagacaaactctaaagaacacgtctgtttacttacaaaatacgaacagccctagagagccgganacgaccgaccggtcgtagttacttacgtgtcgaggaggaggacggtacggggacccggaaaccggtaaaccgttaaccgtaacgtacgtaacgtacggtacggtacggtacggggaccggaaaccgggacccggaccgg

SEQ ID NO: 423506 - DNA, 563 bp, Homo sapiens
  misc_feature: GZ8MTXP02HTEHK.11.25.C03.1.454.CMB.2.raw
  modified_base (286)..(286): a, c, t, g, unknown or other
  modified_base (298)..(298): a, c, t, g, unknown or other
  modified_base (338)..(338): a, c, t, g, unknown or other
  modified_base (355)..(355): a, c, t, g, unknown or other
  modified_base (362)..(362): a, c, t, g, unknown or other
  modified_base (396)..(396): a, c, t, g, unknown or other
  modified_base (409)..(409): a, c, t, g, unknown or other
tcagcgagagataccacgaccggtgctcgatttagtagtgtagatttgggtttggggaggagggagcccagcactgggattccgaggtgtttccattcggtgatcagcactgaacacagaggactcaccatggagttttggctgagctgggtttccttgttgctattttaaaaggagtccagtgtgaggtgcgtctggtggagtctggaggaggcctgactccagccgtggggggtccctgagactctcctgtgcagcctcgtggttcaccgtcagtcacacctanatgagtggtccncaggctcgaggggaggctggagtggtctctttattacagnagtgtatacatatccgnagctcgngcggggcatcaccatctcagacacactcaagacncgtctgtttctanaaatgaacagcctagagtagaccgaatcgaccgacgggccgttagtacgttacgtggtacgacgagagtcggtaccgggacccaacggtaaccgttacgtaacgcgttaacgtcggaaccgtcggtacgggaccgaacgggtaccctacccggg

SEQ ID NO: 423507 - DNA, 624 bp, Homo sapiens
  misc_feature: GZ8MTXP02GCTJH.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtggtctcctttattacagcagtggtagtacatattccgcagactccgtggcgggggccattcaccatctccagacgacaaactctaaagaaccacgtcttcgtttactacaaaatacgaaacacggccctaggacgaacgcccgtaatcgaaccaccggggtaccggttagtaactttaccgtggtgacggaaggacggtagtccgggggaccccaacgggtaaaccgtttacctaaccggtactaagtcgggaaccggttcggcgggggacccgaaaacgggggtacccaacccggg

SEQ ID NO: 423508 - DNA, 620 bp, Homo sapiens
  misc_feature: GZ8MTXP02IK6CL.11.25.C03.1.454.CMB.2.raw
  modified_base (368)..(368): a, c, t, g, unknown or other
  modified_base (378)..(378): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtcgggttcaccgtcagtcacacctacatgagttcgggccgccaggctccgaggggaagggctggagtggtcttcctttatttacagctagtgtagtacatatccgnacgctccggngcgggggccattccaccatctccagacacaactcaagacacgtctgtttactacaaatagaacagcctagagacgaccgagtacgaccgaccgggtaccgttagttaacttacgttaggtggtacggaaggtaggtaacggttccgggggaaccctaaacggtaccgtttaaacctacgtacgttaagtcgggtaccggttacggtacgggggtacccgaaacggggtacccgtaacccggg

SEQ ID NO: 423509 - DNA, 574 bp, Homo sapiens
  misc_feature: GZ8MTXP02HRD1F.11.25.C03.1.454.CMB.2.raw
  modified_base (368)..(368): a, c, t, g, unknown or other
  modified_base (463)..(463): a, c, t, g, unknown or other
  modified_base (486)..(486): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctctggggttcaccgtcagtcacacctacatgagttgggtccgccaggctccgaggggaagggctgggagtgggtctcctttattacagcagtgtagtacatattccgnagactccggtgacgggggccattcacctatctaccagacaacaaactctaaagaacagtctgtttactacaaatgaacagcctgacgagaccganacgacgacggcttagtacttagngtcgacgaagagtaggtacgggaccctaaacggtaacgttacctacgagtaagtcggacgtcggacgggaccgaaacgggacctacgg

SEQ ID NO: 423510 - DNA, 554 bp, Homo sapiens
  misc_feature: GZ8MTXP02JY777.11.25.C03.1.454.CMB.2.raw
  modified_base (361)..(361): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgcaggctccgaggggagggctggagtggtctcctttattacagcagtggtagtacatatccgnagactccggtgcggggccattccacatctccagagacaactactaaagaacacgcttgtttcttacaaatgaaacagcctgagagccgatcgacacggccttgtattactgtgacgagagagtcgggggacccaacggaaccgttacgacgtctaagtcggacgtcgtcgggggaccaacggggacctaccgg

SEQ ID NO: 423511 - DNA, 645 bp, Homo sapiens
  misc_feature: GZ8MTXP02IOH71.11.25.C03.1.454.CMB.2.raw
  modified_base (365)..(365): a, c, t, g, unknown or other
  modified_base (391)..(391): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccgaggctccgaggggaaggggctgggagtggtctcctttattacagcagtgtagtacatactcgnagactcgtggcggggctactccactntcacagacacactacaaagactacgtctttacgtttactaacaaatacgaacacgccgtaggagacgccgtaagtaccggaccgacgggtccgttagttaaacttcgtgggtacgacggaaagggacggtacgggttcccgggggaacccctaaacgggttaaccgttaaccggtacgtaccgttaaggtacggggtaccgggttacgggaccgggggaaacccccgtaaacgggggaacccccgttaaccggg

SEQ ID NO: 423512 - DNA, 584 bp, Homo sapiens
  misc_feature: GZ8MTXP02HGPL7.11.25.C03.1.454.CMB.2.raw
  modified_base (360)..(360): a, c, t, g, unknown or other
  modified_base (402)..(402): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggcctcagggactcccgtgagccgattctctggctaccaactcgtgggaacncagcccactctagacccatccagccgggacccagggcctagngggaatggaggctaggaccttagttagtttgtacgagggccggtagggacgaggccaggcaaccgtcgaccccgtttatacgttcgtttacggaaaccgttcggggaaccctaaacggggtccctaccggtcgtttacggacggttaccaacggtccccaaaacggccccctaaaacccccg

SEQ ID NO: 423513 - DNA, 579 bp, Homo sapiens
  misc_feature: GZ8MTXP02HONUR.11.25.C03.1.454.CMB.2.raw
  modified_base (363)..(363): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctgtcgggttcaccgtcagtcacacctacatgagttgggtccgccgaggcctccgaggggaagggcgtggaggtgggtcttctttatttacagcagtgtagtanatatcgcagctccgtgcggggccattcacctatctccagacgacaactactaaagaacacgtcttgtttcttacaaatcgaacagcctagagacgaccgatacgacgaccggccgtagttacttactggtgacgtagacggacggtcgggacctaaacgtaacgttactacgactaaggttcgacggttcgacggggaccaacggggacctaccgg

SEQ ID NO: 423514 - DNA, 574 bp, Homo sapiens
  misc_feature: GZ8MTXP02JD2DV.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgagggagggctggagtggtctcctttattacagcagtggtagtacatacttccgcagacctccgtggcgggggccagttccacctatcctaccagacgactaactactaaacgaactacgcttcgtttacttacaaatcgaaacagccctaggacgacgacccgatcgacaccggccgtagtacttactgtgcgagagagtcggggacccaacggtacgtacgtacgactaagtcggacgtcgtacggggaccaacgggaccaaccgg

SEQ ID NO: 423515 - DNA, 543 bp, Homo sapiens
  misc_feature: GZ8MTXP02GHYDF.11.25.C03.1.454.CMB.2.raw
  modified_base (374)..(374): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccaggggaaggggctggagtgggtctcctttatttacagcagtggtagtacatatccgcagactccgtgnggggccattcaccatctccagagacaactctaagaacacgctgtttctacaaatgaacagcctgagagccgatgacacggccgtgtattactgtgcgagagagtcgggggacccacggaacgttactacgctaagtcggacgtcgtggggaccaacgggaccgtaccgg

SEQ ID NO: 423516 - DNA, 606 bp, Homo sapiens
  misc_feature: GZ8MTXP02FWNOZ.11.25.C03.1.454.CMB.2.raw
  modified_base (341)..(341): a, c, t, g, unknown or other
  modified_base (363)..(363): a, c, t, g, unknown or other
  modified_base (511)..(511): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagttggtccgccaggctccgaggggaagggctggagtggtcttcctttattacngcagtggtagtacatactccgnagtactccgtgggacgggggcctattccacctattccaccgaagaacgaactaaacgtttaaagaaacctacgtcttgtttactacaaatgaaacagcctagagacgccgatacggaacgaccggccgtagtaactttaacgtgtagngaagagaggtaccggggacccaaacggtaacgttacgtacgacttaggtaacggtacgtcggtacggggaccgaaacgggacccgacggtacccg

SEQ ID NO: 423517 - DNA, 580 bp, Homo sapiens
  misc_feature: GZ8MTXP02HGQ61.11.25.C03.1.454.CMB.2.raw
  modified_base (304)..(304): a, c, t, g, unknown or other
  modified_base (503)..(503): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtccctgagactctcctgtgcagcctcgtgggttcaccgtcagtcacacctacatgagttcgggtccnccaggctccgaggggagggctggagtggtctctttatttacagcagtgtagtacatattccgcagactccgtggcgggggccattccaccattcaccagacacaactctaaagaacacgtcttgtttctacaaatgaacagtcctagaacgagccaagtcgacgaccggtccgtagtacttacgtgtgacgaaggacgnggtcggggaccccaacgtaaccgttacacggactaagtcgggaactcggagggggacccaaaggggacccaaccggg

SEQ ID NO: 423518 - DNA, 595 bp, Homo sapiens
  misc_feature: GZ8MTXP02JVFSF.11.25.C03.1.454.CMB.2.raw
  modified_base (502)..(502): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggccgcaggctccgagggagggctggagtgggtctcctttattacagcagtggtagtacatattccgcagtactccgtgacgggggccgattccacatctccagagacaactctaaagaaccacgtctcgtttactacaaatgaaactagccctagacgagccgaagtcgaacaccgggccgttaggtaattaccgtgtcggacgaggagnggtacgggggaccctaaacggtaaccgttaacgtaccggctaagtcgggaaccgttcggtcgggggacccgaaacgggggaccctaacccggg

SEQ ID NO: 423519 - DNA, 613 bp, Homo sapiens
  misc_feature: GZ8MTXP02IOIVF.11.25.C03.1.454.CMB.2.raw
  modified_base (299)..(299): a, c, t, g, unknown or other
  modified_base (343)..(343): a, c, t, g, unknown or other
  modified_base (363)..(363): a, c, t, g, unknown or other
  modified_base (391)..(391): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctctgggttcaccgtcagtcacacctacatgagttgggccnccaggctccgaggggaagggctggagtgggtctcctttattacngcagtggtatacatatccgnagactccgtgcgggggccatcaccatcncagagacaactacaaagaacaacgcttgtttcttacaaaatcgaaacagacctagaacgacgacccggtaatacgaaccgaaccgggtccggttagttaaactttacgtgtggacggaaggacggaaggtcgggggaccccaaacgggtaaaccgttaaccgtacgtacgtaagtacgggacgttcggtacgggggaccgaaacgggggaccctaaccgggg

SEQ ID NO: 423520 - DNA, 675 bp, Homo sapiens
  misc_feature: GZ8MTXP02HV8ML.11.25.C03.1.454.CMB.2.raw
  modified_base (370)..(370): a, c, t, g, unknown or other
  modified_base (406)..(406): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtcagtcacacctacatggagttcgggtccgccaggctccgaggggaagggctggagtggtcttcctttatttacagcagtggtagtacatattccgnagactccggtgacgggggcctattccgacccatccnccaagacaacactacaagaacacgctttagtttcttacaaatgaacaggcctagacgtacgcctagtacgaaccgaccgggtacccgttagttaacgtttaccgtgggttacgccggtaaaagggacggtacggttaccggggggaccccctaaaacgggttaaccgttttaaaccgaacccggtacgttaaacgggttacgggaaacccggtttccggggtaccggggggaaccccgaaaacgggggtaaccccgttaaccccggggg

SEQ ID NO: 423521 - DNA, 708 bp, Homo sapiens
  misc_feature: GZ8MTXP02HS28P.11.25.C03.1.454.CMB.2.raw
  modified_base (641)..(641): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgaggttcgggtcccgccgaggcctccgagggggaacgggcgtggggaggttcggggtccttaccttttagtttacgagtcgtaggttggtaagtacacttacgttcccgctacgaccttcccgggtagggacgggggtccctaattccgacccctatccctaccaagtacgaaccaaacctactaaaacgaacctacgtcttcgttttactaactaaatcgaaacacgacctaggaacgtacgccgtaagtcgaaccgaccgggtccgttagttacttacgtggtacgacgggaaggaggtaacggtccgggggaacccctaaaccgggttaaacgttacccgtaacccggtnttaaacggtcggggtaaccggttccgggtaccgggggacccgaaacgggggtaccctaaacccgggg

SEQ ID NO: 423522 - DNA, 585 bp, Homo sapiens
  misc_feature: GZ8MTXP02HRZS9.11.25.C03.1.454.CMB.2.raw
  modified_base (296)..(296): a, c, t, g, unknown or other
  modified_base (333)..(333): a, c, t, g, unknown or other
  modified_base (352)..(352): a, c, t, g, unknown or other
  modified_base (361)..(361): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagtggccncaggctcgagggaggctggagtggtctctttattacngcagtgtatacatatccgnagactccgngcggggccattcacctatcacagacacaactcaaagacacgtcttgtttctacaaatcgaaacagcctaggacgagacccgatacgaacgaccgggtccgttagttaacttacgtggtgacgaaggacgtaggtccggggacccctaaacggtaaaccgttactaacgctaaggttcgggaaccgttcggacgggggacccaaaacgggggtacccctaccggg

SEQ ID NO: 423523 - DNA, 615 bp, Homo sapiens
  misc_feature: GZ8MTXP02GZHLZ.11.25.C03.1.454.CMB.2.raw
  modified_base (266)..(266): a, c, t, g, unknown or other
  modified_base (427)..(427): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaanccaggccagtcccctgtatggtcatctatcaagatgtgaagccggccctacgacggggacctcccgtaggacgccgtacttcgtctcggctacccaaactcgtacggggacacgaccgcccactctacgacccataccgacgaccgggacccaggactagnggagtacggacgcgtagtacttatttagttgtacgaggggtaccggtagggacacgggacacgaccgtacgtcgtacccgtttagtcggttaccgtttacgggaacggttaccgggaaccgtaacgtccgtaaccgttcgttacgaacggttaccgaacgtacccgaaaccggacccctaaacccccg

SEQ ID NO: 423524 - DNA, 546 bp, Homo sapiens
  misc_feature: GZ8MTXP02GJR9R.11.25.C03.1.454.CMB.2.raw
  modified_base (338)..(338): a, c, t, g, unknown or other
  modified_base (359)..(359): a, c, t, g, unknown or other
  modified_base (367)..(367): a, c, t, g, unknown or other
  modified_base (369)..(369): a, c, t, g, unknown or other
  modified_base (381)..(381): a, c, t, g, unknown or other
  modified_base (474)..(474): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgcaggctccgaggggagggctggagtgggtctctttattacngcagtggtagtacatatccgnagactcgngnggggcatcaccntctcagacgacaactcaaagaacacgtctgtttctaacaaatgaaacagcctaggaagacgaccgatgaaccgacggccgtagtattacgtgngacggagagtagtcggggacccagtaacgttacacgctaagtcggacgtcgcggggaccaagggtaccacgg

SEQ ID NO: 423525 - DNA, 561 bp, Homo sapiens
  misc_feature: GZ8MTXP02GGOJ3.11.25.C03.1.454.CMB.2.raw
  modified_base (362)..(362): a, c, t, g, unknown or other
  modified_base (373)..(373): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgaggggaagggctggagtgggtctcctttattacagcagtggtagtacatatccgnagactccgtgnggggccattcaccatctcagagacaactcaaagaacacgtctgtttctacaaaatgaaacagcctagagagccgaatcgaaccacgggccgtagtaattactgtgtgacgagagtcgggggaccccaaggtaaccgttactacggctaagtcggaacgtcgtagggggacccaaggggccctaacggg

SEQ ID NO: 423526 - DNA, 533 bp, Homo sapiens
  misc_feature: GZ8MTXP02H6MUC.11.25.C03.1.454.CMB.2.raw
  modified_base (349)..(349): a, c, t, g, unknown or other
  modified_base (357)..(357): a, c, t, g, unknown or other
  modified_base (368)..(368): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagcctggggggtccctgagactctcctgtgcagcctctgggttcaccgtcagtcacacctacatgagttggtccgccaggctcagggagggctggagtggtctcctttatttacagcagtgtagtacntattccgnagactccgtgngggggccattcaccatctccagagacaactctaaagaacacgctgtttcttcaaatgaacagcctgagagccgatgacacggccgtgtaattactgtgcgagagatcggggacccacgacgtactacgctaagtggacgtcgtacgggccgaagggaccctacgg

SEQ ID NO: 423527 - DNA, 522 bp, Homo sapiens
  misc_feature: GZ8MTXP02IC4BR.11.25.C03.1.454.CMB.2.raw
  modified_base (237)..(237): a, c, t, g, unknown or other
  modified_base (259)..(259): a, c, t, g, unknown or other
  modified_base (360)..(360): a, c, t, g, unknown or other
  modified_base (448)..(448): a, c, t, g, unknown or other
  modified_base (496)..(496): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgaganataaatatacttgtgtatcaanagaagccaggccacgtcccctgtatggtcatctatcaagatgtagaagcggcctcgagggactccgtgagccgattctctggctaccaactcgtgggaacncgagcccactcacgacccatccgacggccgggacccaggctagtcggatcggagctagtacttaatttagttgcgagggcgtaggacngcagcactgccgttatcgtcgttcgaacgtcggacctaggtcaccgtntgactcgacgacccgacgccaacccg

SEQ ID NO: 423528 - DNA, 569 bp, Homo sapiens
  misc_feature: GZ8MTXP02FWL1N.11.25.C03.1.454.CMB.2.raw
  modified_base (340)..(340): a, c, t, g, unknown or other
  modified_base (360)..(360): a, c, t, g, unknown or other
  modified_base (371)..(371): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggtcaccgtcagtcacacctacatgagttgggtccgccaggcctccgaggggaagggctggagtggtctctttattacngcagtgtagtacatatccgnagacctccggngacgggggccattcgaccatctccaagagacaaactctaaagaacacgactgtttacttacaaaatacgaacaacgcctagaagacgccgaatacgacaccggccgtgttaattacgtgtgcgagtagatcgggggacccaacggtacgttaacacggctaagtggacgtcgtcggggaccgaacgggaccgaaccgg

SEQ ID NO: 423529 - DNA, 563 bp, Homo sapiens
  misc_feature: GZ8MTXP02I9UPF.11.25.C03.1.454.CMB.2.raw
  modified_base (301)..(301): a, c, t, g, unknown or other
  modified_base (363)..(363): a, c, t, g, unknown or other
  modified_base (372)..(372): a, c, t, g, unknown or other
  modified_base (425)..(425): a, c, t, g, unknown or other
  modified_base (472)..(472): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccnccaggcctccgaggggagggctggagtggtctctttattacagcagtgtagtacatatccgnagactccgngcggggccattcacatctccagacgacaactctaaagacacgcttgtttctanaaatgaaacagcctagagacgccgatcgacacggcgttgtacttcgngtgcgagagacggtcggggacccaacggtacgttaaccgacgtactaagtcgggacgtcggtacgggggaccaacggggaccctaaccggg

SEQ ID NO: 423530 - DNA, 579 bp, Homo sapiens
  misc_feature: GZ8MTXP02HE4F9.11.25.C03.1.454.CMB.2.raw
  modified_base (370)..(370): a, c, t, g, unknown or other
  modified_base (388)..(388): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggggttcaccgtcagtcacacctacatgagttcgggtccgccaggctccgaggggagggctggagtggtctctttattacagcagtgtagtacatatccgcagactcgtgngggggccattccacatcnccagagacaactcaagaacacgcttgtttctacaaatgaactaggcctaggacgacgccgagtacgaccgacgggtccgttagttacttacgtggtagacggtaagaggtacggtcgggggacccctaacggtaaccgttacacgtactaagtcggacgtcggtcggggacctaacggggaccctaccggg

SEQ ID NO: 423531 - DNA, 533 bp, Homo sapiens
  misc_feature: GZ8MTXP02G4M84.11.25.C03.1.454.CMB.2.raw
  modified_base (289)..(289): a, c, t, g, unknown or other
  modified_base (363)..(363): a, c, t, g, unknown or other
  modified_base (372)..(372): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactccctgctctggaattgaattgagagataaatatacttgttggtatcaacagaagccaggccagtcccctgtattggtnatctatcaagatgtgaagcggccctcgagggactcccgtgagccgtattctctggctccaactcgtagggaacncacgccacnctgaccatcagccggaccagctatggatggagctagactattatgtcaggcgtggacagcagtcacgtgcccgttatcgtcttacggaaacgttcgggaaccgaacggtctaaccgttcgttacggacgtacacggacccaaaccgggccctaaacccccg

SEQ ID NO: 423532 - DNA, 634 bp, Homo sapiens
  misc_feature: GZ8MTXP02HLQ51.11.25.C03.1.454.CMB.2.raw
  modified_base (370)..(370): a, c, t, g, unknown or other
  modified_base (463)..(463): a, c, t, g, unknown or other
  modified_base (517)..(517): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctggaggaggcctgatccagccgtggggggtccctgagactctcctgtgcagcctcgtgggttcaccgtcagtcacacctacatgagttcggccgcgaggcctccggaggggaagggctgggaggtggtcttcctttattacagcagtggtatacatactccgnagacgtccggtggcggggccattccaccatcctaccagaacgaccaaactactaaagaaccacgtcttagtttacctaacgaaaatcgaaacncgtcctaggaacgacgccgagtacgaaccgaccgggtccgtagttaacttacgngtgacgaggacggtacggtaccggggaccccaaacgggttaaaccgttacgtaaccgtcgtaaggtcgggaaccggttcgggacgggggaacccaaacgggggtaaccctacccggg

SEQ ID NO: 423533 - DNA, 672 bp, Homo sapiens
  misc_feature: GZ8MTXP02FUTA2.11.25.C03.1.454.CMB.2.raw
  modified_base (368)..(368): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggagggaggcctgatccagccgtggggggtccctgagactctcctgtgcagcctcgtgggttcaccgtcagtcacacctacatgagttgggccgccaggctccgaggggagggctggagtgggtctcctttattacagcagtggtagtacatacttccgnagactccggtggacgggggccattccaccatcctaccagacgacaaactactaaagaaccacgtcttgttttcttaacaaatacgaaactacggcctaggaacgacggacccgtaagtacgaaccgaccggggtcccgttaggtttaaactttaccgtgggtacggacggaaaggacgggtaacggttccgggggaccccctaaaacggttaaaaccggtttaaccgaaccggtaccgttaaggtacgggggaaccgtttccgggacgggggaacccgaaacgggggaaccccggtaacccggg

SEQ ID NO: 423534 - DNA, 600 bp, Homo sapiens
  misc_feature: GZ8MTXP02IT2JB.11.25.C03.1.454.CMB.2.raw
  modified_base (577)..(577): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtcgtgggaggaggcctgatccagccgtggggggtccctgagactctcctgtgcagcctcgtgggttcaccgtcagtcacacctacatggagttcgggccgccaggcctccgaggggaacggggctggggaggtgggttccttccttttatttacagtctaggtggtaagtacattacttccgcagactccggtggacgggggcctattccaccatcctccaagacgacaactcaaagacacgtcttgtttactacaaatcgaacagcctagacgacgccgatacgaccgacggtaccgttagtaacttcgtgtgacgagaggacgtcgggggacccaacggtacgttacacgtacgtaagtcggacgttcggnggggacccaaggggaccctacgg

SEQ ID NO: 423535 - DNA, 656 bp, Homo sapiens
  misc_feature: GZ8MTXP02FS8ZD.11.25.C03.1.454.CMB.2.raw
  modified_base (297)..(297): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtcgtggaggaggcctgatccagccgtgggggtcctgagactctcctgtgcagcctcgtgggtcaccgtcagtcacactacatgagttcggccncaggctccgaggggaggctgggaggtgggttcttaccttttattacgagtctaggtggtaagtactattacttcccgactacgtaccgtcccggtagggacggggggccctattacccaaccctattcctacccgaaaggtaaacgaacctaaaaccttacgtaaaacggaaacctaacgttccttcgtttttacctaactaaaatacgaaacaggtccctaggaacggacgacccgaagtaccgaaccgtaccgggtccgtagttaattcgtggtgacgagagacggtcggggacccaaacgtaccgttacacgtagtaagtcggtacgttcggacgggaccgaacgggacctaccgg

SEQ ID NO: 423536 - DNA, 576 bp, Homo sapiens
  misc_feature: GZ8MTXP02HCDQ5.11.25.C03.1.454.CMB.2.raw
  modified_base (285)..(285): a, c, t, g, unknown or other
  modified_base (299)..(299): a, c, t, g, unknown or other
  modified_base (342)..(342): a, c, t, g, unknown or other
  modified_base (363)..(363): a, c, t, g, unknown or other
  modified_base (389)..(389): a, c, t, g, unknown or other
  modified_base (392)..(392): a, c, t, g, unknown or other
  modified_base (461)..(461): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctanatgagttcgggccnccaggcctccgaggggagggctgggagtggtctctttattacngcagtgtagtacatactccgnagactccgtgacggggccattccacntcncagacacaactcaaagaacacgtcttcgtttactacaaatcgaacagcctagagacgccgatcgaaccncgggtcgtagtacttacgtgtcgacgtagacgacggtccggggacccaacggtaacgttacgacgtacgtaacgtcggaccggtcgtacgggggaccaacgggggaccctaccgg

SEQ ID NO: 423537 - DNA, 661 bp, Homo sapiens
  misc_feature: GZ8MTXP02H45NW.11.25.C03.1.454.CMB.2.raw
  modified_base (196)..(196): a, c, t, g, unknown or other
  modified_base (379)..(379): a, c, t, g, unknown or other
  modified_base (410)..(410): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggagtccagtgtgaggtgcgtntggtggagtctgggaggaggcctgatccagccgtggggggtccctgagactctcctgtgcacgcctcgtgggttcaccgtcagtcacacctacatgagttcgggcccgcacggctccgaaggggaacggggctgggagtcgggtcttccttttatttacagcgagtggtagtacatactccgnacgacgtccggtggcggggctattccactanctacagacaaacaactctaaagaacacgtctttagtttaccataaaagtcgaaactaaggccttaggaaacgagaccctagacgaacccgacgggggtcctttaaggtaacttttacggtgtacggacgtaaggaacggtacgggtacccgggaaccctaaaccggttaaaccgttacgtaccggtacgttaacggtacggtaccggtaccgggtacggggaaccccggaaaacggggtaccccgaccggg

SEQ ID NO: 423538 - DNA, 568 bp, Homo sapiens
  misc_feature: GZ8MTXP02JV8OK.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtggtatcaacagaagccaggccacgtcccctgtattggtcatctatcaagatgtagaagccggccctcgagggactcccgtgagcccgtattctctggctccaacgtcgtagggaacgcacgccacgtctcgacccatcgacgccgggacccaggctagtggatggagcgtagacttattagtgtacgagggtcgtagggacagcgacgcctacgtcgtaccgtttatcggttcgttacgggaaacgtcgggaaccgtaacgggtccgtaccggttcgttcgaccggttacaccgacccgaacggaccccaaaccccg

SEQ ID NO: 423539 - DNA, 551 bp, Homo sapiens
  misc_feature: GZ8MTXP02I1P6U.11.25.C03.1.454.CMB.2.raw
  modified_base (364)..(364): a, c, t, g, unknown or other
  modified_base (482)..(482): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtggggttcaccgtcagtcacacctacatgagttgggccgccaggctccgaggggaagggctgggagtggtctcgtttattacagcagtggtagtacatatccgnagacgtccgtggacgggggccattccaccatcctccagacgacaactcaaagaacacgtcttgtttcttacaaatgaaacagcctagagagccgatgaccgcggccttgtacttgtgngcgagagagcggggacccaacggtacgtactgactaagcggactcggacggaccgaacgggacctacgg

SEQ ID NO: 423540 - DNA, 645 bp, Homo sapiens
  misc_feature: GZ8MTXP02HSC5L.11.25.C03.1.454.CMB.2.raw
  modified_base (301)..(301): a, c, t, g, unknown or other
  modified_base (360)..(360): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctggaggaggcctgatccagccgtggggggtccctgagactctcctgtgcagcctcgtgggttcaccgtcagtcacacctacatgagttggtccncaggctccgaggggaggctggagtggtctctttattacagcagtgtatacatattccgnacgactccggtgcgggggcctattccaccatcctaccaagacgaacaaactactaaacgaccacgtctttgttttacctacaaaatcgaaacagtccctaggaacgacgaccgtaatcgaaccgaccgggtccgttagttaactttacgtggtacgacgaaggacggacggtaccgggggacccctaaaacggtaaccgtttaaccgtaaccgtacgttaaacggtcggggtaaccggttccgggtacgggggaaccccgaaacgggggtaccccgtaaccgggg

SEQ ID NO: 423541 - DNA, 552 bp, Homo sapiens
  misc_feature: GZ8MTXP02IQ6AA.11.25.C03.1.454.CMB.2.raw
  modified_base (362)..(362): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaagccggccctcgagggactccctgagccgattctctggctccaactcgtgggaacncacgccactctgaccatcgagccgggacccaggctagtggatggaggctagacttatttagttcgtcgagggcggtagggacagcgaagccacgtcgtcccgtttatcggtcgttacgggaacgtcggggaccgtaacggtcctaccggttcgttcggacgtcacgacccgaacggacccccaaaccccg

SEQ ID NO: 423542 - DNA, 681 bp, Homo sapiens
  misc_feature: GZ8MTXP02JGLB5.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcggccgccaggctccgaggggaagggctggaggtggtcttcctttattacagtcaggtggtaagtacacttacttccgacacgtaccgtccgggtagggacgggggtccctaagttacccaaccctacttcctacccgaagaacgacctaaacctacgtaaagaacctacgtcttacgtttctaactaaagtcgaaactacggcctaggaacgaccgaccgagtacgaaccgtacccggtccgttagttaacttacgtgggtcgacggaaggacggtacggtacccgggggacccctaaaacgggtaacccgtttaaccgtaacgtaccgtaaggtcgggtaaccggtcgggtacgggggaaccctaaacgggggaccctaacccggg

SEQ ID NO: 423543 - DNA, 560 bp, Homo sapiens
  misc_feature: GZ8MTXP02JOR3A.11.25.C03.1.454.CMB.2.raw
  modified_base (343)..(343): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaggggctggagtggtcttcctttattacngcagtggatacatatccgcagctccgtgcggggccattcaccatctccagagacaactctaaagacacgcttgttctacaaatcgaacagcctgacgagccgatacgacgacggcgttagtacttacgtgtgcgtaagagatgggacgacccgtaacgtaaccgttacacgtaacgtaacgtcgggacgtcggtacggggacccgaacgggtacccg

SEQ ID NO: 423544 - DNA, 609 bp, Homo sapiens
  misc_feature: GZ8MTXP02IWUS5.11.25.C03.1.454.CMB.2.raw
  modified_base (298)..(298): a, c, t, g, unknown or other
  modified_base (362)..(362): a, c, t, g, unknown or other
  modified_base (442)..(442): a, c, t, g, unknown or other
tcagcgagagataccacgaccggtgctcgatttagtagtgtagatttgggttgggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtgggggtccctgagactctctgtgcagcctcgtgggttcaccgtcagtcacacctacatgagttcgggccnccgtaggctccgaggggaaggctggagtggtctctttatttcagcagtgtagtacatattccgnacgactccgtgcgggggcctattcaccatctaccgagacgacaactataaacgaacacgcttagtttctacaaatgaacngcctgaagtgcccgatacgaccgacggtcgtgttaacttacgtgtcgacgtaggagacggtccggggacccgaaacgtaaccgtttaacgtaccgggtacttaaggtacgggtaccggttaccgggtaccgggggaacccggaaaaccggggtccccgtaacccggg

SEQ ID NO: 423545 - DNA, 661 bp, Homo sapiens
  misc_feature: GZ8MTXP02HTVZL.11.25.C03.1.454.CMB.2.raw
  modified_base (338)..(338): a, c, t, g, unknown or other
  modified_base (601)..(601): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttggccgcaggctccgaggggagggctggagtggtctctttatttacngcagtggtatacatattccgcagtactccggtgcgggggcctatcaccctatcctaccagacgaaccaaaccgtactaaacgaaaccacgtactttgttttacctaacaaaattcggaaaacctagcccgttaggaaacgtacggacccggaatcgggaaccaccggggtacccgttagttaacgtttaaccgtgggtcgacgggacggtaaggaaccgggtccgggggacccctaaacgggtaaccgttaaccgtacccggngttaacgtcggggaccgtttacgggcgggggaacccaaacgggggtacccctaacccggg

SEQ ID NO: 423546 - DNA, 544 bp, Homo sapiens
  misc_feature: GZ8MTXP02FGPC5.11.25.C03.1.454.CMB.2.raw
  modified_base (366)..(366): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagttgggtccgccaggctccgaggggaaggggctgggagtgggtctcctttattacagcagtggtagtacatattccgnagactccgtgcggggccgattcaccatctccagagacaactctaaagaacacgctgtttctacaaatgaacagcctgagagccgatgacacggctgtactactgtgacgagagagtcggggacccaacggaacgttacacgctaagtggacgtcgtaggggaccaaggggccaacggg

SEQ ID NO: 423547 - DNA, 556 bp, Homo sapiens
  misc_feature: GZ8MTXP02G8FIM.11.25.C03.1.454.CMB.2.raw
  modified_base (273)..(273): a, c, t, g, unknown or other
  modified_base (297)..(297): a, c, t, g, unknown or other
  modified_base (340)..(340): a, c, t, g, unknown or other
  modified_base (359)..(359): a, c, t, g, unknown or other
  modified_base (366)..(366): a, c, t, g, unknown or other
  modified_base (368)..(368): a, c, t, g, unknown or other
  modified_base (378)..(379): a, c, t, g, unknown or other
  modified_base (381)..(381): a, c, t, g, unknown or other
  modified_base (385)..(385): a, c, t, g, unknown or other
  modified_base (402)..(402): a, c, t, g, unknown or other
  modified_base (464)..(464): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctggttttccttgttgctattttaaaaggagtccagtgtgaggtgcgtctggtggagtcgtggaggaggcctgatccagccgtgggggtccctgagactctcctgtgcagcctcgtgggttcaccgtnagtcacactacatgagttcggccnccaggcctccgaggggagggctggagtggtctcctttattacngcagtgagtacatatccgnagctcgngngggcatcacnncncagnacaatcaaagacacgtnttgttactaacaaatcgaaacacgcctagagacgccgatagaccgacggcctagtactacgngtcgagaagacgagtcggggaccccaagggtaacttacgaacgctaagtcggaacgttcggacgggggacccaaaagggggccctaaccggg

SEQ ID NO: 423548 - DNA, 570 bp, Homo sapiens
  misc_feature: GZ8MTXP02I4WMN.11.25.C03.1.454.CMB.2.raw
  modified_base (345)..(345): a, c, t, g, unknown or other
  modified_base (467)..(467): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggccgccgaggctccgaggggaaggggctggagtgggtctcctttattacngcagtggtagtacatattccgcagactccggtggacgggggccattccaccatctaccagagaaccaaactctaaagaacacgtcttcgtttactacaaaatgaactagcctgagagccgangacgacggccgtagtacttactgtcgacgagagagtcgggggacccaacggtaacgttactacgctaagtcggacgtcggcggggaccgaacgggacctacgg

SEQ ID NO: 423549 - DNA, 575 bp, Homo sapiens
  misc_feature: GZ8MTXP02F08EA.11.25.C03.1.454.CMB.2.raw
  modified_base (261)..(261): a, c, t, g, unknown or other
  modified_base (302)..(302): a, c, t, g, unknown or other
  modified_base (406)..(406): a, c, t, g, unknown or other
  modified_base (438)..(438): a, c, t, g, unknown or other
tcagcgagagataccacgaccggtgctcgatttagtagtgtagatttgggtttggggggagaggagcccagcactgggattcccaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtacagcctntggcttcaccttcattacctatggcatgcacgtcgggtccnccagacctcgaggcgagggggctggaggtgggtgctagtttattcatatgagtagaaatagtagtacttctattcagacctcggtagaacgggcatcaccgtcncccagacacaattccagcacacgctgtatcgngaacaaatacgaacgacgacccgtggaagaggaccgtggaacggacgaacgggtcttaggtagttacttacgtagtcgtaacgtaaagttacttaacgtagtaggtaggtacggtacggtacgggggtactttacgg

SEQ ID NO: 423550 - DNA, 516 bp, Homo sapiens
  misc_feature: GZ8MTXP02J3D0L.11.25.C03.1.454.CMB.2.raw
  modified_base (489)..(489): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccacccctcagtgtccgtgtccccaggacagacagccagaatccccctgctctggaattgaattgagagataaatatactttgtgtatcaacagaagccaggcccagtcccctgtatggtcatctatcaagatgtagagcggccctgacgggatccccgtgacgccgatttcctctggcctccaactcgtagggaacgcagcccactctacgacccatccgagccgggacccaggctagtgatgagctgacttattattgtcagggcgtgggacagcagcacgtgcccgttatgtcttcggaactcggaccagtcacgtntgactcacgcccaacgcccaaaccccg

SEQ ID NO: 423551 - DNA, 645 bp, Homo sapiens
  misc_feature: GZ8MTXP02IK1G7.11.25.C03.1.454.CMB.2.raw
  modified_base (376)..(376): a, c, t, g, unknown or other
  modified_base (411)..(411): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctaggaattgaattgagagataaatatacttgtgtatcaacagaagccaggcccacgtcccctgtattggtcatctatacaagatgtagaagccggccctagagggactcccgtaggacgccgtatttctctggcctaccaacgtcgtacgggaacncacgcctactctacgacactcgacggccggacccnggactagcgagtcggagtcgtagtacttatttacgttgtaccgaggggtaccggtagggaccaggaccacggccctaacgtccggtaccccgtttaagtttccggttaccggtttacgggaaaaccggttcgggggtaaaacccctaacggggttcccgtaaacccggttcgtttacggaaccggttaccgaaacccggtacccccgaaaaccgggaccccctaaaaacccccg

SEQ ID NO: 423552 - DNA, 649 bp, Homo sapiens
  misc_feature: GZ8MTXP02F231U.11.25.C03.1.454.CMB.2.raw
  modified_base (383)..(383): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagttcgggtccgccaggctccgaggggaagggctggaggtgggtcttcctttatttacagcagtggtagtacatacttccgcagacgtccgtggngggggccattccacctatctaccagacgaactaaactactaaagaaccacgtcttgtttacttacaaatagaaactagccctaggaagacgacccgaatcggaaccgacggggtacccgttagttaacgtttaccgtgggtacgaccgggaaggacggtacggttaccgggggaaccccaaacgggttaaccgttaacctaccgggtacttaaggtacgggtaacgtccggtagggggaccccgaaaagggggaccctaacccggg

SEQ ID NO: 423553 - DNA, 710 bp, Homo sapiens
  misc_feature: GZ8MTXP02JACMI.11.25.C03.1.454.CMB.2.raw
  modified_base (267)..(267): a, c, t, g, unknown or other
  modified_base (315)..(315): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccaggccggtcggggggtccctgacgtactctcctgtgcncgtcctgtgggtccacgtcagtcacacctacatggaggttcgggtccnccgacggcgtaccggagggggaaggggcgtggggaggttcgggttccttccgtttttaatttacgacggtcgtagggttggtaaagtactaacttacgttcccgactaacggtaccgtccgggtagggaccggggggtcctacgttaccaacctacttacccgaccgaaagaacgaaacctaaacttacgaaaacgaacctaaccgttctttacgtttacttaaacaaagtacgaaacgtacggcctaaggacgacgccgaagtcgaaccgtcggtctagttactacgtgtcggagaggaggacggtccggggaccctaaacggtaacgttaacctacggtacgtaacgtcggggtacggtcgggtacgggaaccggaacgggaccgtaacccgg

SEQ ID NO: 423554 - DNA, 558 bp, Homo sapiens
  misc_feature: GZ8MTXP02GAOQO.11.25.C03.1.454.CMB.2.raw
  modified_base (340)..(340): a, c, t, g, unknown or other
  modified_base (374)..(374): a, c, t, g, unknown or other
  modified_base (391)..(391): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtgggttcaccgtcagtcacacctacatgagttggccgccaggctccgaggggagggctggagtggtctctttattacngcagtggtagtacatattccgcagactccggtgnggggccattcaccatcncagagacaaactctaaagaacacgtctagtttactacaaaatgaacagcctagagagccatgacacggccgtgtaatactgtgacgaagaggagtcggggacccaacggtaaaccgttactacgactaagtcggaacgttcgagggggaccaaaggggccaaccggg

SEQ ID NO: 423555 - DNA, 665 bp, Homo sapiens
  misc_feature: GZ8MTXP02GYRLV.11.25.C03.1.454.CMB.2.raw
  modified_base (300)..(300): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctgtgggttcaccgtcagtcacacctacatgagttcgggccnccgaggctccgaggggagggctggagtggtctctttattacagcagtgtagtacatactccgcagacctccggtggcgggggccctaagttccaacctatcctacccaaggaacaacctaaaccttacaaaacgaaaccacggtacttcggttttacttaacaaaagttacgaaaccagtacccttaggaacgaacggcccgaagtacgaaccgtacgggtcccgttagttaattaccgtagtgacgaaggaggtacggtcgggggaacccctaacgggtaaaaccgttacccgtaacgaccgttaaggtcggggtaaccgttcgggaccgggggaacccaaacgggggaccccgtaacccgggg

SEQ ID NO: 423556 - DNA, 817 bp, Homo sapiens
  misc_feature: GZ8MTXP02JHK9K.11.25.C03.1.454.CMB.2.raw
  modified_base (284)..(284): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggtcaccgtcagtcacacctacngtgagttcggtccgccgaggcctaccgaggggaacgggcgtgggaggtcgggtccttaccgttttacttaccagtccgtaggttcggtaagtacacttacgttacccgacacggtactcccgggtaggaccgggggcctacttaccaacctatacccgtaccgaaacgaacgaaacctaaaccgttactaaaaacgggaaccctaaacggttcctttacggttttacccttaaacaaaaacgttaccggtaaaaccacggtacccccgttagggaaacgtaccgggtaccccggaagttaaccgggaacccgtaaacccggggttcccggtttaaggttaaacctttaccgtttggggtacggaccgggttaaagggaacgggtttaccggggtacccggggaaaccccgttaaaacgggttaaacccggtttaaacccgttaccggtaccgttaaaggtaccgggggttaaaccgttccgggggtaaacccggggtaacccggaaaacgggggttcccccgtaaacccgggg

SEQ ID NO: 423557 - DNA, 572 bp, Homo sapiens
  misc_feature: GZ8MTXP02JJ72T.11.25.C03.1.454.CMB.2.raw
  modified_base (299)..(299): a, c, t, g, unknown or other
  modified_base (341)..(341): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagttacacctacatgagttgggtccnccaggctccgagggaggggctggagtggtctctttatttacngcagtggtagtacatacttccgcagactccggtggacggggccattcaccatctccagagaccaactacaaagaacacgcttgtttcctacaaaatgaaacagcctgagcgccgatggaccacgggcctagtattacgtgtgcgagaggagtcgggggaccccaaggaacgtttacacgtctaagtcgggacgtcgtcgggggacccaaacgggggaccctacgggtaccc

SEQ ID NO: 423558 - DNA, 582 bp, Homo sapiens
  misc_feature: GZ8MTXP02IKMXC.11.25.C03.1.454.CMB.2.raw
  modified_base (358)..(358): a, c, t, g, unknown or other
  modified_base (367)..(367): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacactacatgagttcgggccgcaggctccgaggggagggctggagtggtctctttattacagcagtgtagtacatactccgnagactccgngacgggggccattccaccatctaccagacacaaactacaaagaactacgtcttacgtttactacaaatcgaaacagcctagagagccgagtcgaccgacgggtccgtagttaacttacgtgtagacgagaggacggtcggggacccaacggtaacgttaaccgtacgacttaagtcgggaccgtcggacggggaccgaaacgggaccctaaccgg

SEQ ID NO: 423559 - DNA, 560 bp, Homo sapiens
  misc_feature: GZ8MTXP02JUAF5.11.25.C03.1.454.CMB.2.raw
  modified_base (371)..(371): a, c, t, g, unknown or other
  modified_base (390)..(390): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgagggagggctggagtgggtctcgtttattacagcagtggtagtacatatccgcagactccgtgngggggccattccaccatcnccagacacaaactctaaagacacgctgttctacaaatgaacagcctagagagccgatgacacgggccgtagtacttacgtgtgcggagagaggtcgggggaccccaacggtaaccgttacgacgactaagtcggaccgtcggtacggggacccaaaggggacccaccggg

SEQ ID NO: 423560 - DNA, 597 bp, Homo sapiens
  misc_feature: GZ8MTXP02FWMFQ.11.25.C03.1.454.CMB.2.raw
  modified_base (363)..(363): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgccaggctccgaggggagggctggagtggtctctttattacagcagtggtagtacatacttccgnagactccggtggcgggggccattcaccatctccagacgacaactctaaagacacgcttgtttctacaaatgaaacagcctagacgagccgatgaccgacggccgttagtaacttacgtgtgcggaaggaggacggtccgggggaccccaaaggtaaacccgtttacctacggaccgttaagtacggggtaacgttccggtacgggggacccgaaacgggggtaccctaaccggg

SEQ ID NO: 423561 - DNA, 593 bp, Homo sapiens
  misc_feature: GZ8MTXP02H3QF2.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcggccgccaggctccagtggaaggggctggagtgggtctcctttattacagcagtgtataccatactcgcagactcgtggagggccattccacatctccagagacaactctaaagaacacgcttgtttcctaacaaatgaaaactcgacctaggagacgaccgatacggaccacggtccgttagttattactgggtacgcggaaggaggacgtccgggggacccctaacggtaaacgtttaacccgacggcgttaacgtaggggacccgttcggacgggggacccgaaaacgggggaccccg

SEQ ID NO: 423562 - DNA, 549 bp, Homo sapiens
  misc_feature: GZ8MTXP02FEXMI.11.25.C03.1.454.CMB.2.raw
  modified_base (472)..(472): a, c, t, g, unknown or other
  modified_base (482)..(482): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggtcaccgtcagtcacacctacatgagttgggtccgccaggctccgaggggagggctggagtggtctcctttattacagcagtgtagtacatattccgcagactccgtggcggggccgattcaccatctccagagaacaactctaaagacacgtctgtttcttacaaatgaaacagcctagagagccgatgaccacggccgtgtattacngtgcgagagngtcggggcccacggtaacgttacacgctaagtcggacgtcgtcgggggaccaacggggccctaacgg

SEQ ID NO: 423563 - DNA, 555 bp, Homo sapiens
  misc_feature: GZ8MTXP02INK7V.11.25.C03.1.454.CMB.2.raw
  modified_base (243)..(243): a, c, t, g, unknown or other
  modified_base (258)..(258): a, c, t, g, unknown or other
  modified_base (347)..(347): a, c, t, g, unknown or other
  modified_base (414)..(414): a, c, t, g, unknown or other
  modified_base (523)..(523): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccacctcagtgtccgtgtccccaggacagacagccagaactccctgctctggaattgaattgagagataaatntattgttgtatcaanagaacgccaggccacgtccctgtattggtcatctatacaagatgtagaacggccggccctgagggactcccgtggacgcccgtattccncgtcggcctaccaacgtcgtacggggaaacctcgacgcctactctacaccatcgacggccggacccnggctagcggagtgacggctagacttattagtcgacgagggcgtaggacagcacgcctacgtcgtacccgttgtcgtaccgtcggaacgtcggaccgacgtccaccgttntcgactcgaacgtcccgaacgtacccaacccg

SEQ ID NO: 423564 - DNA, 579 bp, Homo sapiens
  misc_feature: GZ8MTXP02JD2TM.11.25.C03.1.454.CMB.2.raw
  modified_base (300)..(300): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagntgtgaagcggccctcgagggactccctggacgccgtattcctcgtcggctcccaactcgtgggaaccgcacgccactctcgacccatccgacgccgggacccaggctagtggatgagctagacttattattgtcgagggtcgtacggggacaggcaaggctacgtcgtacccgttagtcgttaccgttccgggaaacgtcggggaacctaaacgggtccctaacccggttcttacgggacgttccgacgacccccgaacgggaccccctaaaacccccg

SEQ ID NO: 423565 - DNA, 563 bp, Homo sapiens
  misc_feature: GZ8MTXP02I7HRV.11.25.C03.1.454.CMB.2.raw
  modified_base (362)..(362): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaagggctggagtggtctcctttattacagcagtgtagtacatatccgnagactccggtgagggggccattccaccatctcagagacaactctaaagaacacgcttcgtttcttacaaatgaaacagcctgacgagcccgatcgacgacggcctgtacttactgtgcgagagagtcgggggaccctacggaacgttacgtacgtactaagtcggacgtcggtacggggacccaacggggaccctaaccgg

SEQ ID NO: 423566 - DNA, 703 bp, Homo sapiens
  misc_feature: GZ8MTXP02HDNTG.11.25.C03.1.454.CMB.2.raw
  modified_base (369)..(369): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccaggctccgaggggaacgggcgtggagtgggtctcctttatttacagcagtggtagtacatattccgnacggacttccggtggacggggggtccctaaatttccgaaccctacttcctaccgaacgaaacgaacctaaacccttacgtaaaacgaaaccaaccgtctttacggtttactttaaccgaaaattacgaaactaacgcccgttaggaacgaacgcccgaagtacggaaccgtaccggggtaccgttaggttaactttaccggtacggtacggacggtaacggacggtacgggtacccggggaacccctaaacggttaaccgttaacgtaccgtacgttaacgtacgggtaccggttcgggaccggggtaacccggaaccggggtacccgtaacgg

SEQ ID NO: 423567 - DNA, 585 bp, Homo sapiens
  misc_feature: GZ8MTXP02JB7YH.11.25.C03.1.454.CMB.2.raw
  modified_base (302)..(302): a, c, t, g, unknown or other
  modified_base (346)..(346): a, c, t, g, unknown or other
  modified_base (381)..(381): a, c, t, g, unknown or other
  modified_base (491)..(491): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctctgggttcaccgtcagtcacacctacatgagttcgggtccnccaggcctccgaggggaagggctggagtggtctcctttattacngcagtggtagtacattactccgcagctccggtggngggggccattccaccatcacagacacaactctaaagacacgtcttgtttactacaaatgaactagcctagacgacgaccgatacgaaccgacggtccgtagtacttacgngtcgacgtaggagaggtcgggggacccaacggtaacgttaccgacgtcgtaagtcggaccggttcggacggggaccaacggggaccgtaaccgg

SEQ ID NO: 423568 - DNA, 579 bp, Homo sapiens
  misc_feature: GZ8MTXP02JSJKI.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggcctccgaggggagggctggagtgggtcttctttattacagcagtggtagtacatattccgcagactccggtggcgggggcctagttccaccatcctcagacgacaactctaaagacacgtcttcgttctacaaatgaacagcctaggacgagccgaatcgaccgacgggccgtgttacttacgtgtgcgaagagacgtcggggacccaacgtaaccgttaccacgcgtaagtcgggtaacgtcggtacgggggacccaacggggaccctaccgg

SEQ ID NO: 423569 - DNA, 660 bp, Homo sapiens
  misc_feature: GZ8MTXP02I9GLZ.11.25.C03.1.454.CMB.2.raw
  modified_base (300)..(300): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggttcaccgtcagtcacacctacatgagttcggccnccaggctccgaggggagggctggagtgggtctcctttattacagcagtggtagtacatacttccgcagtactccggtaggacgggggcctattccgaaccctagttacctacccaaggaacgaaacctaaaccttactaaaacggaaacccaacggtctttccggttttacttaacaaaattcggaaaaccaggtacccctaggaacgacggacccgtaatcggaaccgtaccgggccgttagttaacttaccgtggtaggacgtaggacggaggtccgggggacccctaaacggtaaccgttactacggacttaagtcgggaacgtcggtacggggaccaaacggggaccctaaccggg

SEQ ID NO: 423570 - DNA, 613 bp, Homo sapiens
  misc_feature: GZ8MTXP02H9GZV.11.25.C03.1.454.CMB.2.raw
  modified_base (441)..(441): a, c, t, g, unknown or other
  modified_base (484)..(484): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtggggggtccctgagactctcctgtgcagcctctggggttcaccgtcagtcacacctacatgagttggtccgcaggctccgaggggagggctggagtggtctcctttattacagcagtggtagtacatacttccgcagactccggtggcggggccgtattccacctatcctacagacacaactcaaagacacgtcttgtttctacaaatcgaaacncgctagagacgcgagtcgaccgacggtcgttagttacttacgnggtacggacggtaggacggtcgggtacccgggaacccctaaacggttaaccgttacgtaaccggtcgttaacggtacgggtaaccggttcggggaccgggggaacccgaaacggggaccccgtaccggg

SEQ ID NO: 423571 - DNA, 659 bp, Homo sapiens
  misc_feature: GZ8MTXP02J2WTT.11.25.C03.1.454.CMB.2.raw
  modified_base (299)..(299): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttgggtccnccaggcctccgaggggaagggctggagtgggtcttcctttattacagcagtgtagtacatacttccgcagactccgtggacgggggccattccactatcctaccagacaacaactactaaagaacacgtcttcgtttacttacaaaattacgaaacagacctggaacgacgaccgacgtagaaccgtaccgggccgttaggtaaactttaccgtggtacggaccgaaggaacggtaacggtccgggggaaccccctaaacgggtaaaacccggtttaaccgtaaccggtaccgttaagtacggggaccgttaccgggtacgggggaccccgtaaaaccgggggacccgtaaaccccgggg

SEQ ID NO: 423572 - DNA, 615 bp, Homo sapiens
  misc_feature: GZ8MTXP02HK4IC.11.25.C03.1.454.CMB.2.raw
  modified_base (362)..(362): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgactccaggccgtcggggggtccctgagactctcctgtgcagcctcgtggttcaccgtcagtcacacctacatgagttggccgcaggctcgaggggagggctggagtggtctctttattacagcagtgtatacatactccnagactcggtggacgggggcctatccacctatccgtaccagaacaaccaaactactaaacgaactcgctttagtttacttaacgaaattcgaaactcgcctaggagtacgccgaatcgaccgaccggtccgttagtacttacgtggtacgacgtaggagtcggtaccggggaccctaaacggtaacgttacctaacggtcgtaagtcgggtaccgttcggaccgggggacccgtaacggggaaccctacccggg

SEQ ID NO: 423573 - DNA, 594 bp, Homo sapiens
  misc_feature: GZ8MTXP02G9KL3.11.25.C03.1.454.CMB.2.raw
  modified_base (259)..(259): a, c, t, g, unknown or other
  modified_base (286)..(286): a, c, t, g, unknown or other
  modified_base (298)..(298): a, c, t, g, unknown or other
  modified_base (395)..(395): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctgggaggaggcctgatccagccgtggggggtccctgagactctctgtgcngcctgtcggtcacgtcagtcacactanatgagtcggccncaggcctcgaggggagggctggagtggtcttctttattacagcagtgtagtacatactccgcacgactccgtggcggggcctatcactatcacaganacaactacaaagacacgtcttacgttactacaaaatcgaaacagccgtagaacggacgacccgagtacgaaccgtaccggtccgttagttaacttacgtggcgacggaaggacgaggtccgggggaacccaaacgggtaaccttaccgtacgactaaggtcggacggtacggacggggaaccgaacgggaccctaccgg

SEQ ID NO: 423574 - DNA, 792 bp, Homo sapiens
  misc_feature: GZ8MTXP02GJO12.11.25.C03.1.454.CMB.2.raw
  modified_base (257)..(257): a, c, t, g, unknown or other
  modified_base (277)..(277): a, c, t, g, unknown or other
  modified_base (308)..(308): a, c, t, g, unknown or other
  modified_base (482)..(482): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctgggaggaggcctgatccagcctgggtcgggtccctgagactctcctgtgcngcctcgtgggttccaccgtnacgtccacacctacatggtaggttcgggccnccgaggcctaccggaagggggaacggggtcgtaggggacggtttcggggttcctttaccctttttaagttaccgaggtcgtaaggttcgggttaaacgtacccaagttaccttcccggacgtaaggtacccgttccgggtgggggaccgggggtccctaaattcccaaaccgtntcccgtacgaagaacgaaacctaactaacgtaaaagaacccgtaacgtcctttacgttttacccttaaacgaaaacgttacgtaaaaccacggtaccgttagggaacgaccggacccgtaagtaccggaaccgtaccggggtcccgttaggttaacgtttacgttgggtaccgacgggtaaggaaggtaccgggtacccgggggaacccctaaaaccgggttaaacccgtttaacggtaccggtaacgtttacgggtacggggtaacccggtcggtaccgggggaaaccccgaaacgggggtaacccccg

SEQ ID NO: 423575 - DNA, 558 bp, Homo sapiens
  misc_feature: GZ8MTXP02I2OV1.11.25.C03.1.454.CMB.2.raw
  modified_base (365)..(365): a, c, t, g, unknown or other
  modified_base (373)..(373): a, c, t, g, unknown or other
  modified_base (375)..(375): a, c, t, g, unknown or other
  modified_base (391)..(391): a, c, t, g, unknown or other
  modified_base (397)..(397): a, c, t, g, unknown or other
  modified_base (451)..(451): a, c, t, g, unknown or other
  modified_base (534)..(534): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggttcaccgtcagtcacacctacatgagttggtccgccaggctccgaggggaaggggctggagtgggtctcctttatttacagcagtggtatacatatccgnagactcgngnggggccatcaccatcnccaganacaactcaaagaacacgcttgtttctacaaaatgaaacagcctagagagccgangacacggccgtagtattactgtgcggaagagacgtcgggggacccccaaaggtaaaccgtttacacgctaagtggaacgtcgngggggcccaaaaggggccaacggg

SEQ ID NO: 423576 - DNA, 560 bp, Homo sapiens
  misc_feature: GZ8MTXP02JVOFZ.11.25.C03.1.454.CMB.2.raw
  modified_base (368)..(368): a, c, t, g, unknown or other
  modified_base (375)..(375): a, c, t, g, unknown or other
  modified_base (377)..(377): a, c, t, g, unknown or other
  modified_base (392)..(392): a, c, t, g, unknown or other
  modified_base (484)..(484): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggctccgaggggaaggggctggaggtgggtcttcctttatttacagcagtgtagtacatatccgnagctcgngnggggccatcacatcnccagacgacaactctaaagacacgcttcgtttcttacaaatgaacagcctaggagagccgatgacgcggccgtgtattcgtgtcgcgagagnggtcggggacccacggaaacgttacacgtactaagtcggacgtacggtgggggaccctaacggggaccctaccggg

SEQ ID NO: 423577 - DNA, 569 bp, Homo sapiens
  misc_feature: GZ8MTXP02JV6SR.11.25.C03.1.454.CMB.2.raw
  modified_base (366)..(366): a, c, t, g, unknown or other
  modified_base (389)..(389): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgagttcggtccgccaggctccgaggggaaggggctggaggtggtctcctttattacagcagtggtagtacatattccnagctcgtgcggggccattccacntctccagacgacaactctaaagaacacgtcttgtttcttacaaatagaaacagcctagacgagccgatcgaacgaccgggccgttagttacttacgtgtgacgagagagcggggacccaaacggtaacttacacgtctaagtcggacgtcggcggggaccgtaaacggggaccctaccgg

SEQ ID NO: 423578 - DNA, 563 bp, Homo sapiens
  misc_feature: GZ8MTXP02F63GG.11.25.C03.1.454.CMB.2.raw
  modified_base (301)..(301): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccacgtcccctgtatggtcatctatcaagntgtagacgccggccctcgaggactcccgtagacgccgtattcctcgtcggcctaccaactcgtagggaccacgacgcccactctacgaccatccgacggccggaccctaggctagtggatggagctagacttattagttgtacgagggtcgtaggagtacgcgaagcctacgtcgtcccgttagtcgtacgttacggaacgtcggaccgtaacgtccaccgttgttcgacgtacgaccgaccgaaccggaccctaaaccccg

SEQ ID NO: 423579 - DNA, 699 bp, Homo sapiens
  misc_feature: GZ8MTXP02HF4LL.11.25.C03.1.454.CMB.2.raw
  modified_base (301)..(301): a, c, t, g, unknown or other
  modified_base (368)..(368): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtcagtcacacctacatgagttgggccnccaggctcgaggggagggctggaggtggtcttctttatttacagcagtgtagtacattacttccganacgactccggtgacgggggcccaattccacctatcctaccgaagaacgaaccaaactacaaacgaaacacgtcttacgtttccttacaaaagtcgaaacagccctagacggagtaccgaagtcgaaccgaccgggtacccgttagttaacgtttaaccgttggtacgggaccggtaaacgggtaacggacgggttacccgggggaaccccgtaaaccggttaaaaccggtttaacccgtacggtaaccgtaaggttaccgggggtaaaccggttccggggttaccggggggaaacccggtaaaaccgggggaaccccgtaaaccccggggg

SEQ ID NO: 423580 - DNA, 775 bp, Homo sapiens
  misc_feature: GZ8MTXP02JO88R.11.25.C03.1.454.CMB.2.raw
  modified_base (721)..(721): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtgggaggaggcctgactccacgccggtcgggggtccctgagctctcctgtgcacgcctcgtcgggttccaccgtcacgtcacacctacatggtaggttcgggccgccgacggccgtccggaagggggaaggggtcgtgggagggttcgggttccttaccgttttattacgagtcgtaggttaggtaacgtactaacgttacgttcccggactaacggtacccgttccgggtacggggaccgggggtcccgtaacgttacccaaccctacgtacccgtacccgaaaggaaaccgtaaccctaaacttaaccgtaaaaccggaaaccgtaccggttccttttaccggtttttaccttaaaccgaaaaattaccggaaaactccgggtaccgttagggaaacggtacgcccggtaaagtaccgggaaacccgcgggttccgttagttaacttaccgtgggtccgagaaggacggacggtcccgggggaaaccccaagggtttaacctacggtaccgngttaacgtcgggtaacgttcgggacggggaacctaacgggggaccctacccggg

SEQ ID NO: 423581 - DNA, 582 bp, Homo sapiens
  misc_feature: GZ8MTXP02HZYH0.11.25.C03.1.454.CMB.2.raw
  modified_base (297)..(297): a, c, t, g, unknown or other
  modified_base (316)..(316): a, c, t, g, unknown or other
  modified_base (359)..(359): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctaattttaaaaggagtccagagtgaggtgcgtctggtggagtctggaggaggcctgatccagccgtgggggtcctgagactctcctgtgcagcctcgtgggttcaccgtcagtcacactacatgagttggtcncaggctccgaggggagggntggagtggtcttctttattacagcagtggtatacatattccgnacgactccggtgcgggggcctattccaccatcctcagacgaacaactactaaagaaccacgtcttcgttttctacaaaatgaaacacgcctagagagccgatgacgacggccttagtacttacgtgtcgacggaagaggacggtcggggacccaaacggtaaccgtttacgaacgtctaagtcggaacgttcggacgggggacccaaacggggtacccaccgg

SEQ ID NO: 423582 - DNA, 526 bp, Homo sapiens
  misc_feature: GZ8MTXP02JTSJS.11.25.C03.1.454.CMB.2.raw
  modified_base (312)..(312): a, c, t, g, unknown or other
  modified_base (359)..(359): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttgtatcaacagaagccaggccagtcccctgtattggcatctatcaagatgtgaagcgccctnagggactccctgagccgtattctctggctccaactcgtacgggaacncagccactctcgaccatcaagccgggacccaggctagtggatgaggctaggacttattacgttgtcagggcgtaggggacaggcagcacgtcgcccgttatcggtcttacggacgtcgggaccaacgggtccacgtcgttgacgtcacgcccaacggcccaaccccg

SEQ ID NO: 423583 - DNA, 663 bp, Homo sapiens
  misc_feature: GZ8MTXP02F7UI6.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtcgtgggaggaggcctgatccagccgtggggggtccctgagactctcctgtgcagcctcgtgggtcaccgtcagtcacacctacatgaggttcgggtcccgccgaggcctaccggagggggaacggggcgtgggaggttgggttccttaccgtttatttacgagctaggtggtagtacattacttccgcacgtaccgtccggtgggcgggggcctattccacctactcctaccgagaacgaacctaaacctactaaaacgaacctacgtcttgttttacttaacaaatcgaacacgtcctaggacgacgaccgtaagtacggaaaccgtcgggtaccgtagtttaattaccgtggtacgacggtaaggacggtacggtccgggggacccctaacggtaaccgttacgacggtctaaggtcgggacggttcggacggggacgaacccggggactacccgg

SEQ ID NO: 423584 - DNA, 612 bp, Homo sapiens
  misc_feature: GZ8MTXP02G6AXW.11.25.C03.1.454.CMB.2.raw
  modified_base (258)..(258): a, c, t, g, unknown or other
  modified_base (277)..(277): a, c, t, g, unknown or other
  modified_base (289)..(289): a, c, t, g, unknown or other
  modified_base (301)..(301): a, c, t, g, unknown or other
  modified_base (341)..(341): a, c, t, g, unknown or other
  modified_base (343)..(343): a, c, t, g, unknown or other
  modified_base (361)..(361): a, c, t, g, unknown or other
  modified_base (370)..(370): a, c, t, g, unknown or other
  modified_base (391)..(391): a, c, t, g, unknown or other
  modified_base (397)..(397): a, c, t, g, unknown or other
  modified_base (420)..(420): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtggggggtccctgagactctcctgtgcngcctcgtgggttcaccgtnagtcacacctanatgagtcggccncaggcctcgaggggaggctggagtggtcttcctttatacngnagtgtagtacatatccgnagacgtcgnggcggggccattccaccatcncaaganaacaactacaaagacagtctttnttactaacaaaatcgaaacagccgtagaacggacgaccgatacggaccgccggtcgttagtaacttcgtggtacgacggtaagacgtacgggacccggggtaccccaaaacggttaacccgttacctaacggtacttaaggtcggggtacccgtcggggacgggaccccgaaaacggggacccgtaacccgg

SEQ ID NO: 423585 - DNA, 726 bp, Homo sapiens
  misc_feature: GZ8MTXP02IA1QE.11.25.C03.1.454.CMB.2.raw
  modified_base (618)..(618): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccagccggtggggggtccctgacgactctcctgtgcacgtcctcgtgggttccaccgtcagtcaccacctacatgaggttcggccgcgaggcctccggagggggagggcgtgggaggttcgggttcttaccttttattacgagtcgtaaggttaggtaacgtactaacgttacgttacccgactaacggtaccgttccgggtagggaccgggggtcccgtaaacttcccaaacctacttcccgtaccgaaacggaactaaacccaaacttaccgtaaaacgaacccgtaaccgtttcctttacgtttttacctaaacaaaagttcgaaaaaccgcgtcccgtaggaacgacgcccgtaagccgaaacgccgggtacttaggttaacttacgngggtacgacggaaggacggtcgggaccggaacccaaacgttaaaccgttcgtaacgcgttaaggtcggaccggtacgggaccggggaacccgaacgggtacccgtccg

SEQ ID NO: 423586 - DNA, 605 bp, Homo sapiens
  misc_feature: GZ8MTXP02I9J61.11.25.C03.1.454.CMB.2.raw
  modified_base (342)..(342): a, c, t, g, unknown or other
  modified_base (362)..(362): a, c, t, g, unknown or other
  modified_base (474)..(474): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggaggaggcctgatccagccgtggggggtccctgagactctcctgtgcagcctcgtggggttcaccgtcagtccacacctacatgagttgggtccgccaggctccgaggggagggctggagtggtctctttatttacngcagtgtagtacatatccgnagactccggtgcgggggccattccaccattcacagagaccaaactactaaagaaccacgtcttagtttcttacaaatcgaaacacgcctaggaagacgacccgatcgaaccnccggggtccttaggtaatttaccgtaggtcggacgaggaggtagtccgggggaccccaacggtaaaccgttaccgacgtactaagtacggaccgttcggacggggacccgaacggggaccccgtaaccggg

SEQ ID NO: 423587 - DNA, 571 bp, Homo sapiens
  misc_feature: GZ8MTXP02HF2H2.11.25.C03.1.454.CMB.2.raw
  modified_base (191)..(191): a, c, t, g, unknown or other
  modified_base (306)..(306): a, c, t, g, unknown or other
  modified_base (309)..(309): a, c, t, g, unknown or other
  modified_base (379)..(379): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcgtggtttcgtgtaggctatttaaaggagtcagtgtgaggtgcgtntggtggagtctggaggaggcctgatccagccgtggggggtccctgagactctcctgtgcagctctggttcacgtcagtcacactacatgagtggtcgcagctccaggaagggcgnggngtggtcgtctttatttacagcagtggtagtacatattcgcagactccgtgaggggcggattcaccactcncacgagacaactacaagaacaacgctcttcttactaaacttaaacgaacgacgacgtacgacgacgacgacgacgacgacggtacgtacgtacgttacgtagtacgacgacgaggacggtacggtaccgtaacgtaacgtacgtacgtacgtaacgtacggtacggtacggtacggaccggacggacgtacg

SEQ ID NO: 423588 - DNA, 579 bp, Homo sapiens
  misc_feature: GZ8MTXP02FXC7I.11.25.C03.1.454.CMB.2.raw
  modified_base (300)..(300): a, c, t, g, unknown or other
  modified_base (318)..(318): a, c, t, g, unknown or other
  modified_base (339)..(339): a, c, t, g, unknown or other
  modified_base (359)..(359): a, c, t, g, unknown or other
  modified_base (385)..(385): a, c, t, g, unknown or other
  modified_base (388)..(388): a, c, t, g, unknown or other
  modified_base (393)..(393): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtgggtcaccgtcagtcacacctacatgagttcggccncaggctcgaggggagggntggagtggtctctttattacngcagtgtatacatactccgnagactccgtgcgggggccattcaccntcncaganacaactacaaagacacgtcttgtttctacaaatagaacagcctaggacgagaccgatcgaccgacggtccgtagttaacttacgtgtcgacgaagaggagtccgggggacccaacgtaaccgttaactacggactaacggtacggacgtccgggtacggggaccgaaacgggggaccctaaccggg

SEQ ID NO: 423589 - DNA, 560 bp, Homo sapiens
  misc_feature: GZ8MTXP02HH3I8.11.25.C03.1.454.CMB.2.raw
  modified_base (366)..(366): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaagcggccctcgagggactcccgtgacgccgtattctctggctaccaactcgtagggaacncacgccactctcgaccatcgagccgggacccaggctagtggatgagctagacttattattgtcgagggtcgtaggacagcagcacgtcgtcccgttaagtcgttaccgttacgggaaacgtacgggaaccctaacgggtccaaccgttcgttaggacgttaccgacgaccccgaaacggacccctaaacccccg

SEQ ID NO: 423590 - DNA, 673 bp, Homo sapiens
  misc_feature: GZ8MTXP02F6CFN.11.25.C03.1.454.CMB.2.raw
  modified_base (236)..(236): a, c, t, g, unknown or other
  modified_base (250)..(250): a, c, t, g, unknown or other
  modified_base (252)..(252): a, c, t, g, unknown or other
  modified_base (254)..(254): a, c, t, g, unknown or other
  modified_base (258)..(258): a, c, t, g, unknown or other
  modified_base (268)..(268): a, c, t, g, unknown or other
  modified_base (277)..(277): a, c, t, g, unknown or other
  modified_base (280)..(280): a, c, t, g, unknown or other
  modified_base (286)..(286): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgaganataatatatgtgtnananagancagcactccngtatgcatntanacaagntgtgagccgcctgaggactccgtgacgcgtatctgtcggctaccacgtcgtacgggaacgcacgcctactctacgaacctactaccgaacgggcccggaacccgagggtacctagtaggacgtaggacggtcttaacggtaacgtttagtttacgttcggtaccggtaacggggtcgggttacggggaacgtacggaccgaaacggtcccgtaaacggtttccggtaccccgtttaaggtttccggggttacccgtttaaccgggaaaccgggtttccggggaaaacccgttaaaccggggttaccctaaccccgggtttgttaacgggtaaccggttacccgaaaccggtacccccggtaaacccgggaaccccctaaaccccccg

SEQ ID NO: 423591 - DNA, 614 bp, Homo sapiens
  misc_feature: GZ8MTXP02JNLZV.11.25.C03.1.454.CMB.2.raw
  modified_base (400)..(400): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagcccgtggggggtccctgagactctcctgtgcagcctcgtggttcaccgtcagtcacacctacatgagttgggtccgccaggctccgaggggaagggctgggagtgggtctcctttattacagtctagtggtagtacatacttccgcagactccgtgacgggggccattccgacctntccgtcaagagacaacctactaacgaactacgacttcgtttctacaaatcgaacagcctaggacgagcccgagtacgaccacggccgttagtacttacgtcgtagcgaggacggtagtcgggggaccctaacggtaaaccgttacgtacgaccgtaagtacgggtaacccgttcggtacgggggaccctaaaacgggggcccctaaacccgggg

SEQ ID NO: 423592 - DNA, 597 bp, Homo sapiens
  misc_feature: GZ8MTXP02I9CNV.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggagggctggagtggtcttctttagttacagcagtggtatacatattccgcacgactccggtgacgggggccattccaccatcctacagacaacaactctaaagacacgtctgtttactacaaatagaacagcctagacgacgaccgatagaccacgggccgttagtacttacgtagtgacgggaagacggacgtcgggggaccctaaacggtaaaaccgtttacacgtactaacggtcgggtaaccgtcggtacgggggacccaacggggaacccctaccgggg

SEQ ID NO: 423593 - DNA, 579 bp, Homo sapiens
  misc_feature: GZ8MTXP02GEFV4.11.25.C03.1.454.CMB.2.raw
  modified_base (300)..(300): a, c, t, g, unknown or other
  modified_base (364)..(364): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctgtgggttcaccgtcagtcacacctacatgagttcgggccncgaggctccgaggggagggctggagtgggtctcctttattacagcagtggtatacatactccgnagactccggtggcggggccattccacctatcctaccagtacacaaacctctaaagaacacgtcttcgtttactaacaaatcgaaacagcctagagagccgaagtcgaacgcggtccgtagttaacttacgtgtgacgagaggacgtcgggggacccacggtaaccgttacacgactaagtcggacgtcggacggggaccgaacgggacctaccgg

SEQ ID NO: 423594 - DNA, 594 bp, Homo sapiens
  misc_feature: GZ8MTXP02GL411.11.25.C03.1.454.CMB.2.raw
  modified_base (455)..(455): a, c, t, g, unknown or other
  modified_base (504)..(504): a, c, t, g, unknown or other
  modified_base (554)..(554): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctccttgcagcctctgggttcaccgtcagtcacacctacatgagttggccgccaggctcgagggagggctggagtggtcttctttatttacagcagtgtagtacatactccgacagactccggtggacggggccgtattccaccatcctaccgagacgaaccaaactactaaagaaccacgtctttagtttccttacaaaatcgaaaacnggaccctggaagacgccgatcggaaccaccgggtccttagttacttcgngtgacgaagagacggtcggggacccctaagtaaccgttactaccgctagnggaccgtcgtacggggaccaacgggacccgtacggtcccg

SEQ ID NO: 423595 - DNA, 605 bp, Homo sapiens
  misc_feature: GZ8MTXP02FMQSJ.11.25.C03.1.454.CMB.2.raw
  modified_base (395)..(395): a, c, t, g, unknown or other
  modified_base (398)..(398): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttcttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttcggccgccaggcctccgaggggagggcgtggagtggtcttcctttattacagtcagtggtagtacatatccgacagacgtccgtgggcggggccattccaccntcnccagacgacaactcaaagacacgtcttgtttactaacaatacgaacacgccgtaggaacgcgaccgagtcgaaccgacgggtccgttagttacttacgtggtcgacgaggacgacggtccggggaccctaaacggtaaccgtttacgaccgtacttaaggtcggaacggttccggacgggggacctaaaacggggccctaaacccgg

SEQ ID NO: 423596 - DNA, 620 bp, Homo sapiens
  misc_feature: GZ8MTXP02IKXCF.11.25.C03.1.454.CMB.2.raw
  modified_base (288)..(288): a, c, t, g, unknown or other
  modified_base (508)..(508): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctgggaggaggcctgatccagccgtggggggtccctgagactctcctgtgcagcctcgtgggttcaccgtcagtcacacctacntggtaggttcgggccgccgaggcctccggagggggaacggggctgggaggtgggtcttcctttatttacagctaggtggtaagtacattacttccgctacgaccgtccggtggacggggggtcctattccgaaccctatcctaccgaagacgaacaaacctacaaacgaacacgtcttcgttttactactaaatacgaacacgtcctagacgacgccganacgacgcggtacgttgtacttacgtgtagcgagaggacgtcggggacccaacggtaccgttactacgactaagtcggaacgtcggacggggaccgaacgggaccctaccggg

SEQ ID NO: 423597 - DNA, 550 bp, Homo sapiens
  misc_feature: GZ8MTXP02HH8NT.11.25.C03.1.454.CMB.2.raw
  modified_base (297)..(297): a, c, t, g, unknown or other
  modified_base (360)..(360): a, c, t, g, unknown or other
  modified_base (368)..(368): a, c, t, g, unknown or other
  modified_base (370)..(370): a, c, t, g, unknown or other
  modified_base (387)..(387): a, c, t, g, unknown or other
  modified_base (391)..(391): a, c, t, g, unknown or other
  modified_base (393)..(393): a, c, t, g, unknown or other
  modified_base (468)..(468): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttggccnccaggctccgaggggaagggctggagtggtctcctttattacagcagtggagtacatatccgnagactcgngnggggccattcaccatcnccananacaaactcaaagacacgctgtttactacaaaatgaaacagcctagagagccgatgacacggccctagtattacgngtgacgagagagtcggggaccccaagtaaacgttacaacgcttaagcggaacgtcgacggggccaaaacggggaccaccggg

SEQ ID NO: 423598 - DNA, 616 bp, Homo sapiens
  misc_feature: GZ8MTXP02GTRUE.11.25.C03.1.454.CMB.2.raw
  modified_base (396)..(396): a, c, t, g, unknown or other
  modified_base (493)..(493): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagctcgtgggttcaccgtcagtcacacctacatgagttcgggtccgccaggctccgaggggagggctggagtgggtctcctttattacagcagtggtagtacatactccgcagactccgtggcgggggcctattccaccntctccagacgaacaaactactaaagaacacgtcttcgtttactacaaatgaaacagccgtagagtagtcgatcgacgacggtccgtagtacttacgnggtcgacggtagacggtacggtaccgggggaccccaaacggtaaaccgtttaacgaccggtactaaggtcggggtaaccgttcgggtacgggggaccgaaaacgggggaccctaaacccgggg

SEQ ID NO: 423599 - DNA, 619 bp, Homo sapiens
  misc_feature: GZ8MTXP02FKGJR.11.25.C03.1.454.CMB.2.raw
  modified_base (406)..(406): a, c, t, g, unknown or other
  modified_base (424)..(424): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtgggaggaggcctgatccagccgtggggggtcctgagactctcctgtgcagcctcgtgggttcaccgtcagtcacacctacatgagttcgggcccgccgaggctccgaggggaaggggctgggagtgggtcttacctttattacagctagtggtagtacatacttccgacagactccgtgggacgggggccattaccaccntctaccagagacaacctnaaagacacgtcttgtttactaacaaatagaacagcctaggacgagccgagtacgaaccgacggtccgtagttaacttacgtggtgaccggtaagaggtacggtccggggaccccaaacggtaaaccgtttaaccgacgtaccttaagtcgggaaccggtcggtaccgggggaaccgaaacgggacccgtaaccgg

SEQ ID NO: 423600 - DNA, 702 bp, Homo sapiens
  misc_feature: GZ8MTXP02G5LLK.11.25.C03.1.454.CMB.2.raw
  modified_base (298)..(298): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctggaggaggcctgatccagccgtggggtcctgagactctctgtgcagcctcgtcgggtcaccgtcagtcacacctacatgagttcggtccncgaggccgtccggaggggaacgggcgtggtaggtcggttcttacctttattacgagctaggtaggtacgtacaacgttacgttaccgacacgtaccgtccggtaggggaccgggggtacctacgttacccaacctactcctacgaacgaacgtaaacctaaactacgtaaaacgaacctaccgttactttacgttttacctaaactaaaacgtacgtaaacgacgtaccgttaggaacgtacgaccgtagtacgaaccgaccggtccgttagtacgttcgtaggtacgacgaaggacggacgggtaccgggaacccctaaacggtaaaccgttaccgtaccgtacgtaacggtcggtaaccggttacgggaccggggaaccaaaccggggtacccgaacccggg

SEQ ID NO: 423601 - DNA, 574 bp, Homo sapiens
  misc_feature: GZ8MTXP02I1JB1.11.25.C03.1.454.CMB.2.raw
  modified_base (176)..(176): a, c, t, g, unknown or other
  modified_base (299)..(299): a, c, t, g, unknown or other
  modified_base (336)..(336): a, c, t, g, unknown or other
  modified_base (352)..(352): a, c, t, g, unknown or other
  modified_base (360)..(360): a, c, t, g, unknown or other
  modified_base (362)..(362): a, c, t, g, unknown or other
  modified_base (373)..(373): a, c, t, g, unknown or other
  modified_base (376)..(376): a, c, t, g, unknown or other
  modified_base (379)..(379): a, c, t, g, unknown or other
  modified_base (381)..(381): a, c, t, g, unknown or other
  modified_base (415)..(415): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggngtccagtgtgaggtgcgtctggtggagtctggaggaggcctgatccagccgtggggggtccctgagactctcctgtgcagcctcgtggttcaccgtcagtcacacctacatgagttcgggccnccaggctcgaggggaggctggagtggtctctttatcngcagtgatcatatcgnagctccgngngggccatcacntcncananactaactacaaagacagtctagtttctacaaatnaacagcctagacgcaccgagtcgaaccgccggtcgttagtattacgtgtgcggaaaagcggtacggtccgggggacccctaaacggtaaaccgttacgtaaccgtcctaagtccgggtaacgtcgggacggggacccgaaacggggacccgaacccggg

SEQ ID NO: 423602 - DNA, 591 bp, Homo sapiens
  misc_feature: GZ8MTXP02IYWUC.11.25.C03.1.454.CMB.2.raw
  modified_base (298)..(298): a, c, t, g, unknown or other
  modified_base (319)..(319): a, c, t, g, unknown or other
  modified_base (339)..(339): a, c, t, g, unknown or other
  modified_base (351)..(351): a, c, t, g, unknown or other
  modified_base (367)..(367): a, c, t, g, unknown or other
  modified_base (369)..(369): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagtgggtccnccaggctccgagggaagggcnggagtggtctctttattacngcagtgtagtanatactcgcagactcgngnggggccattccaccatctccagacgacaactctaaagacacgcttgtttactacaaatacgaacacgcctagagacgccgatagaaccgacggtcccgttagtaacgtttacgtggtacgacgaggaacgacgggtcgggggaccccaaacgggtaaccgttaacctaacgcctaagtcggaccgtcggtacgggggacccaaaacggggtacccaaccggg

SEQ ID NO: 423603 - DNA, 547 bp, Homo sapiens
  misc_feature: GZ8MTXP02F97Y8.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaagcggccctgaggcatccctgacgcgattctcgtggcctccactcgtgggaaacgcacgccactctcgaccatcgaggccggacccaggctagtggatgaggtctagtacttattagtgtcgaggcgtagggacagcagctacgtcgtacccgttatcgtcgtttacgggaacgtcgggaaccgtaaggtccaacccggttcgttacggacgtccgaaccggaccccgaaacggacccccc

SEQ ID NO: 423604 - DNA, 592 bp, Homo sapiens
  misc_feature: GZ8MTXP02HIU7S.11.25.C03.1.454.CMB.2.raw
  modified_base (265)..(265): a, c, t, g, unknown or other
  modified_base (378)..(378): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccacctcagtgtccgtcgtcccaggacagacagccagaactccctgctctaggattgaattgagagataaatatacttgtagtatacaacagaacnccagccacgtccctgtatggtacatctatacaagtatgtagaacgccggccctagacgggtactcccgtagacgccgtattcgtcgtcggctaccgaactcggtacgggaacncgacgcctactactacgacctagaccgacggaccgggacccaggtactaggtacgagtcgggagtctagtactttaagttacgttggacggtagggcggtacggaacacggacacgacctacgtcgtaccgtttagtcggttaccgtacggacggtacggtaaccacggtcgtaccgtgttcgacgcaaccggacccaaccgacccctaacccg

SEQ ID NO: 423605 - DNA, 675 bp, Homo sapiens
  misc_feature: GZ8MTXP02HS6Y5.11.25.C03.1.454.CMB.2.raw
  modified_base (263)..(263): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggtaattgattgagagataaatatacttgtgtatcaacagaancagcagtccctgtatgtcatctatacaagatgtagaacgccggccctgagggactcccgtagacggcccgtatttcctcgtcggccttaccccaaacgttccggtacggggaaacgccgtaccgaccctaccgtcctacccggaaccctagtacccggaacgggaccccggggaacccccgaggggtacccgttaacggtcgggtaaagtcgggaaggtccgtaggttacctttaaagttttgtttaacggtccgtaagggggccggttaggggaaccaaggcgtaacgccgtaccgttacgtacccgttttaagtccggttaccggttacggaaacggttacgggaaccgtacgtacccgtacggtaacgttcgacgtcccgacgtaccccgaacggtaccctaaaccccg

SEQ ID NO: 423606 - DNA, 590 bp, Homo sapiens
  misc_feature: GZ8MTXP02GYXDH.11.25.C03.1.454.CMB.2.raw
  modified_base (293)..(293): a, c, t, g, unknown or other
  modified_base (330)..(330): a, c, t, g, unknown or other
  modified_base (350)..(350): a, c, t, g, unknown or other
  modified_base (455)..(455): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtcctgagactctcctgtgcagcctctgggctcaccgtcagtcacacctacatgagttggccncaggctcgagggaggctggagtggtctctttattacngcagtggtatacatactcgnagactcgtggacggggcctatccacatctaccagacgacaactactaaagaaccacgcttagtttacctacaaaattgaaaaccagcctaggaagacgaccgaancgaaccgaccgggtccttagtacttaacgtggacgacggaagaggacgtaccgggggaccccaaacggtaaaccgttacaaccggaactaaggttcgggaaccgttcggacgggggacccaaaacggggaccccg

SEQ ID NO: 423607 - DNA, 560 bp, Homo sapiens
  misc_feature: GZ8MTXP02IZOQB.11.25.C03.1.454.CMB.2.raw
  modified_base (372)..(372): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaagggctggagtgggtctcctttattacagcagtgtagtacatatccgcagactccgtgnggggccattcaccatctccagacgacaaactctaaagaacacgctgtttctacaaatgaacagccctgacgagcccgatagacgacggcgtgtacttactgtgacgtagagagtcgggggacccaacggtaaccgttactacggctaagtcggtacgtcgtcggggaccgaacggggaccctaccggg

SEQ ID NO: 423608 - DNA, 562 bp, Homo sapiens
  misc_feature: GZ8MTXP02JQKGY.11.25.C03.1.454.CMB.2.raw
  modified_base (372)..(372): a, c, t, g, unknown or other
  modified_base (411)..(411): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccagccagtcccctgtattggtcatctatcaagatgtgaacgcggccctcgagggtactcccgtgacgccgtattcgtctacggctaccaactcgtagggaaaccncacgcccactctcgaccatcacggcggacccaggctagnggatgaggctagtaacttattagtgtacgagggtccgtagggacaggcgagccacgtcgacccgttagtcgtcgtacggaaacgtcggggaacctaacggtcctaaccgtcgttacgacgtaccgacgacccgaacggaccccaaaccccg

SEQ ID NO: 423609 - DNA, 652 bp, Homo sapiens
  misc_feature: GZ8MTXP02H7GVX.11.25.C03.1.454.CMB.2.raw
  modified_base (298)..(298): a, c, t, g, unknown or other
  modified_base (318)..(318): a, c, t, g, unknown or other
  modified_base (338)..(338): a, c, t, g, unknown or other
  modified_base (454)..(454): a, c, t, g, unknown or other
  modified_base (519)..(519): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctgggaggaggcctgatccagccgtggggggtccctgagactctcctgtgcagcctcgtgggttcaccgtcagtcaccacctacatgagttggccncaggctccgaggggagggcnggagtggtctctttattacngcagtggtatacatattccgcagactccggtaggcgggggcctaattccaccatcctaccagacgaacactactaaagaaccagtcctttgtttaccttacaaaattcgaaaaccncgtacctaggaacgtacgaccgtagtacggaccgaaccgggtaccggttagttaaacgtttacgnggtacggacggtaaggaacggtacgggtacccgggggaaacccctaaacgggttaaaccgttaccgtacgtacgttaaggtacgggtaccggtaccgggtacgggggaaccccgaaaacggggtaccccacgg

SEQ ID NO: 423610 - DNA, 594 bp, Homo sapiens
  misc_feature: GZ8MTXP02IOL3V.11.25.C03.1.454.CMB.2.raw
  modified_base (275)..(275): a, c, t, g, unknown or other
  modified_base (376)..(376): a, c, t, g, unknown or other
  modified_base (390)..(390): a, c, t, g, unknown or other
  modified_base (393)..(393): a, c, t, g, unknown or other
  modified_base (408)..(408): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtnagtcacacctacatgagttcgggtccgccaggctccgaggggaagggctggagtgggtctcctttattacagcagtgtagtacatatccgcagctccgtgngggggcattcaccntcncagagacaactcaanacacgtctgtttactacaaatacgaacacgcctaggacgtacgccgtagtacgacgtaccgggtccgttagttaacttacgtgtcggacgtaaggacgtaggtcgggggaacccaacggtaaccgttaccgtataccgtaagtacgggacgtcggacggggtaccgaaacggggaccgtaaccggg

SEQ ID NO: 423611 - DNA, 652 bp, Homo sapiens
  misc_feature: GZ8MTXP02GWIQV.11.25.C03.1.454.CMB.2.raw
  modified_base (258)..(258): a, c, t, g, unknown or other
  modified_base (349)..(349): a, c, t, g, unknown or other
  modified_base (371)..(371): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtctggaggaggcctgatccagccgtggggggtccctgagactctcctgtgcngcctcgtggttcaccgtcagtcacacctacatgagttcgggtccgccaggcctccgaggggaagggctgggagtgggtctcctttattacngcagtgtagtacatacttccgnacgacctccggtaggcgggggcctattccacctatcctaccaagaacgaccaaactactaaaggaaccacgtcttagtttacttaacaaaatcgaaacacgtccctagacgtacgccgtaagtacgaaccgaccgggtacccgttagttaaactttaccgtggtacgaccggaaggaacggtacggtaccgggggaccccaaacgggtaaaccgtttacaaccggtctaacgtcgggaaccggttcggtacggggaaccgaacggggtacccgtaacccgg

SEQ ID NO: 423612 - DNA, 706 bp, Homo sapiens
  misc_feature: GZ8MTXP02GBV72.11.25.C03.1.454.CMB.2.raw
  modified_base (252)..(252): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtncagcctctgggttcaccgtcagtcacacctacatgagttcgggtccgccgaggcctccgaggggaacggggctgggagtgggtccttccgtttatttacagtcaggtggtagtacatacttccgcgacgaccgtccggttggcgggggtccctagttaccaccctaactccttacccaaggtaacgaacctaaaccttacctaaaacggaacctaccggtactttacgttttaccttacaaaagtcgaaacagcctaggacgagacccgtagtcgggaccgtacgggacccgttaggttaactttaccgtggttacggacggtaaagacgggtacggttacccgggggaaccccctaacgggtaaacccgtttaccgtaaccgtaccgttaagtaccggggtaacggttccgggtacgggggacccgaaaacgggggacccctaaacccggggg

SEQ ID NO: 423613 - DNA, 624 bp, Homo sapiens
  misc_feature: GZ8MTXP02GQ31Q.11.25.C03.1.454.CMB.2.raw
  modified_base (285)..(285): a, c, t, g, unknown or other
  modified_base (297)..(297): a, c, t, g, unknown or other
  modified_base (506)..(506): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgatccagccgtgggggtcctgagactctcctgtgcagcctcgtggtcaccgtcagtcacacctanatgagttggccncaggctcgagggaggctggagtggtcttctttattacagcagtggtaagtacattactccgcgacgtaccgtccggtgggacgggggcctattccaccatctaccaagacgaacaaactactaaacgaacacgtcttgtttactacaaatacgaacagcctaggaacacggacccaagtcgaaaccgcgggacccgttagtaacttcgnggtgacggtaaggacggtacggtccgggggaaccctaaacggtaaccgttaacgtaacgtactaagtacggggtaccgtacggtacgggggacccgtaaaacggggaccctaaccggg

SEQ ID NO: 423614 - DNA, 608 bp, Homo sapiens
  misc_feature: GZ8MTXP02JV05E.11.25.C03.1.454.CMB.2.raw
  modified_base (257)..(257): a, c, t, g, unknown or other
  modified_base (350)..(350): a, c, t, g, unknown or other
  modified_base (366)..(366): a, c, t, g, unknown or other
  modified_base (378)..(378): a, c, t, g, unknown or other
  modified_base (380)..(380): a, c, t, g, unknown or other
tcagcgagagataccacgaccggtgctcgatttagtagtgtagatttgggtttgggggagaggagcccagcactggggattccgaggtgtttccattcggtgatcagcactgaacacagaggactcaccatggagttttggctcgagctgggttttcctgttgctaattttaaaaggagtccagtgtgaggtgcgtctgggtggagtctgggaggaggcctgatccagccgtggggggtccctgagactctcctgtncagcctctgggttcaccgtcagtcacacctacatgagttcgggtcccgccaggctccgaggggaacggggctggagtggtctcctttattacngcagtggtagtacatntccgcagctcgngngggccatcacatctcagacacaacctctaaagacacgtcttgttactacaaatcgaacacgcctagacgacgtccgatcgaacgccggtcccgtagttaattaccgtgtaggaccgtaaggtagaggtccgggggacccctaaacggtaaaccgtttaacacgtctaaacggttcgggaaaccggttcggtacgggggacccctaaaagggggacccctaacccgggg

SEQ ID NO: 423615 - DNA, 664 bp, Homo sapiens
  misc_feature: GZ8MTXP02JFFDO.11.25.C03.1.454.CMB.2.raw
  modified_base (302)..(302): a, c, t, g, unknown or other
  modified_base (388)..(388): a, c, t, g, unknown or other
  modified_base (407)..(407): a, c, t, g, unknown or other
  modified_base (476)..(476): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtcgtggtggagtcgtgggaggaggcctgatccagccgtgggggtccctgacgactctcctgtgcagcctcgtgggttcaccgtcagtcacacctacatgagttcggccncgaggctccggaggggaggctagggagttgggtcttcctttattacgagcgtaggtggtagtacacttctccgacagaccgtcggngggcggggcctatccaccntcctaccgaagaacgacctaaactacgtaaacgaaccacgtctttcgtttactaacaaaatcgaaaacngtccgtaggaacgagacccgtatcggaaccgccgggtacgtttagtaacgttacgtaggtcggacggaggtaaggaccggtaccgggggacccctaaacgggttaaaccgttaccgtacgtaccgttaaggcggggtaacccggtttgggacggggaaccccggtaaaccggggaaccgtaccccggg

SEQ ID NO: 423616 - DNA, 732 bp, Homo sapiens
  misc_feature: GZ8MTXP02FVM54.11.25.C03.1.454.CMB.2.raw
  modified_base (271)..(271): a, c, t, g, unknown or other
  modified_base (282)..(282): a, c, t, g, unknown or other
  modified_base (293)..(293): a, c, t, g, unknown or other
  modified_base (296)..(296): a, c, t, g, unknown or other
  modified_base (299)..(299): a, c, t, g, unknown or other
  modified_base (309)..(309): a, c, t, g, unknown or other
  modified_base (314)..(314): a, c, t, g, unknown or other
  modified_base (333)..(333): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtgggttttcctgttaggctattttaaaaggagtccagtgtgaggtgcgtctggtggagtctggagggaggcctgactccagccggtgggggtccctgagactctctgtgcagctgtggtcacgtnagtcacactantgtgtcggccncgngcncgagggaggngtggngtggtcttactttatacgngtcgtagtagtagtactacttacgtccgactacgtacgtccggtagggccgggggtacctacgttaccaacccgtacttaccgtaccgaagaaacgtaaacctaaaccgttaacgtaaaacgtaaccgtacgttacctttacgttttaacttaaacgtaaaacgtaacgtaacgtaacgtacgtacggtaacggacggaccggtaacgtacgtaaccggtaaccgggtaccggttacgttaacgttacgttacggtacggtaacggtaacggtaacgggtacgggtaccggggtaacccggtaaaccggttaaaccgttaaccgttaaccgtacgtaacggttacggtaccggtaccgggtaccggggtaaccgggtaaccgggtaacccggtaaccgg

SEQ ID NO: 423617 - DNA, 575 bp, Homo sapiens
  misc_feature: GZ8MTXP02HN61U.11.25.C03.1.454.CMB.2.raw
  modified_base (260)..(260): a, c, t, g, unknown or other
  modified_base (304)..(304): a, c, t, g, unknown or other
  modified_base (408)..(408): a, c, t, g, unknown or other
  modified_base (412)..(412): a, c, t, g, unknown or other
  modified_base (418)..(418): a, c, t, g, unknown or other
  modified_base (466)..(466): a, c, t, g, unknown or other
  modified_base (507)..(507): a, c, t, g, unknown or other
  modified_base (518)..(518): a, c, t, g, unknown or other
  modified_base (539)..(539): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggtagttttggctgagtcttgggttttccttgttgcttaattttaaaaggagtccagtgtgaggtgcgtctggtggagtctggaggaggcctgatccaggccgtgggggtccctgagactctcctgtgcngcctcgtggttcaccgtcagtcacacctacatgagttcgggccnccgaggcctccgaggggaagggctggggaggttgggtcttcctttatttacagctagtgtagtacatactcgcagtacgtccggtgcggggcctattccacctntccncaaganaacaactacgtaaacactacgtcttagtttctaacaaagttcgaaacncgcgtgaacggacgacgagtgactacgggcttagtattcgngtcgcgagagngtacggccaacgtactcacgntaacggtggacttcgggacggaccgaaggcctacgg

SEQ ID NO: 423618 - DNA, 636 bp, Homo sapiens
  misc_feature: GZ8MTXP02JH6L4.11.25.C03.1.454.CMB.2.raw
  modified_base (449)..(449): a, c, t, g, unknown or other
  modified_base (461)..(461): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgatccagccgtgggggtccctgagactctctgtgcagcctcgtggtcaccgtcagtcacacctacatgtaggttcggtccgccgacggctcgaggggagggcgtggagtcggtcttcctttattacagctagtggtagtacacgttactccgacagtacgtccggtggcggggtccatccgacctatcctacagacgactaactactaaagacacgtcttcgtttactanaaactacgaacncgaccgtagacgacgaccgtagtacgacgaccggtccgtagttacttcgtcgtagaccggaggtacgacgggtacccgggggaaccctaacggttaacgttacctacggtaccgtaaggttccggggaccgttcggggtaccgggacccggtaaaccggggacccgttaacccgg

SEQ ID NO: 423619 - DNA, 558 bp, Homo sapiens
  misc_feature: GZ8MTXP02J2T1K.11.25.C03.1.454.CMB.2.raw
  modified_base (298)..(298): a, c, t, g, unknown or other
  modified_base (339)..(339): a, c, t, g, unknown or other
  modified_base (375)..(375): a, c, t, g, unknown or other
  modified_base (395)..(395): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccnccaggctccgaggggagggctggagtggtctctttattacngcagtggtagtacatacttccgcagactccggtggngggggccatccacatctacngagacaactactaaagacacgtctgtttcttacaaatgaacacgcctagagcgaccgatcgacaccgggtccgtgtattactgcgacgagagacgtcgggggacccacggaacgttacacggtctaagtcggacgtcgtacggggccgaacggggaccaccgg

SEQ ID NO: 423620 - DNA, 544 bp, Homo sapiens
  misc_feature: GZ8MTXP02HT8OI.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagtggtccgcaggctccgagggagggctggagtggtctcctttatttacagcagtgtagtacatattccgcagactccgtgcgggggcattcaccatctcagagacaactctaaagaacacgtcttgtttctacaaatgaaacagcctagagagccgatcgacacggccgtgtattactgtgcgagagagtcggggaccctaacgaacgttacacggctaagtcggacgtcgacgggaccaacgggacctaccgg

SEQ ID NO: 423621 - DNA, 591 bp, Homo sapiens
  misc_feature: GZ8MTXP02JNNQD.11.25.C03.1.454.CMB.2.raw
  modified_base (301)..(301): a, c, t, g, unknown or other
  modified_base (342)..(342): a, c, t, g, unknown or other
  modified_base (365)..(365): a, c, t, g, unknown or other
  modified_base (376)..(376): a, c, t, g, unknown or other
  modified_base (393)..(393): a, c, t, g, unknown or other
  modified_base (401)..(401): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtctggaggaggcctgatccagccgtggggggtccctgagactctcctgtgcagcctcgtgggttcaccgtcagtcacacctacatgagttcggtccncaggctccgaggggagggctggagtggtctcctttattacngcagtggtagtacactattccgnacgactccggnggcggggccattccacntctcaganacaactcaaagacacgtcttagtttctacaaatcgaaacagcctagacgagccgatcgacgtaccgggctgtaactacgtggtacgcggtaagacggtagtcgggggaacccccagggtaaacccgttactaacggctaaaggtcggtacgtacgggtacggggaccccgaaagggggaccctaccgggg

SEQ ID NO: 423622 - DNA, 570 bp, Homo sapiens
  misc_feature: GZ8MTXP02IXGPN.11.25.C03.1.454.CMB.2.raw
  modified_base (294)..(294): a, c, t, g, unknown or other
  modified_base (360)..(360): a, c, t, g, unknown or other
  modified_base (371)..(371): a, c, t, g, unknown or other
  modified_base (388)..(388): a, c, t, g, unknown or other
  modified_base (411)..(411): a, c, t, g, unknown or other
  modified_base (426)..(426): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctatttaaaaggagtccagtgtgaggtgcgtctggtggagtctgggaggaggcctgatccagccgtgggggtccctgagactctcctgtgcagcctctgggttcaccgtcagtcacacctacatgagttggccnccaggctccgaggggagggctgggagtgggtctcctttattacagtcagtggtagtacatatccgnagactccgtgngggggccattccacctntctcagagacaacgtcaaagacncgacttgtttactanaaactgaacagcctgacgtacgccgaagtcgaacgacgggccgttaggtacttagtgtagacgaagagacgtcggggacccacggtaaccgtactcgacttaagtcgggaccgttacggcggggaccaacggggaccctaccgg

SEQ ID NO: 423623 - DNA, 568 bp, Homo sapiens
  misc_feature: GZ8MTXP02IZX0T.11.25.C03.1.454.CMB.2.raw
  modified_base (363)..(363): a, c, t, g, unknown or other
  modified_base (472)..(472): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcatgatccagccgtgggggtccctgagactctcctgtgcagcctctgggttcaccgtcagtcacacctacatgagttgggtccgccaggctccgagggaaggggctggagtgggtctcctttattacagcagtggtagtaccatatccgnagacctccgtggagggggcctagttccacctagtcctaccaagagaccaaactctaaagaacacgtcttgtttctacaaatgaaacacgcctagagacgccgatcgacncggcgtgtattactgtcgcgaggacgacgtcggggacccacggtaaaccgttcaacgcgtaagtggaccgtcgtacggggaccgaacggggacccg

SEQ ID NO: 423624 - DNA, 632 bp, Homo sapiens
  misc_feature: GZ8MTXP02G5LG5.11.25.C03.1.454.CMB.2.raw
  modified_base (258)..(258): a, c, t, g, unknown or other
  modified_base (360)..(360): a, c, t, g, unknown or other
  modified_base (369)..(369): a, c, t, g, unknown or other
  modified_base (371)..(371): a, c, t, g, unknown or other
  modified_base (388)..(388): a, c, t, g, unknown or other
  modified_base (392)..(392): a, c, t, g, unknown or other
  modified_base (394)..(394): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtcctgagactctcctgtgcagcctntgggttcaccgtcagtcacacctacatgagttgggccgcaggctccgaggggaagggctggagtgggtctcctttattacagcagtgtagtacatattccgnagactccgngnggggccattcaccatcnccananacaaactcaaagaacacgcttgtttacttacaaaatgaaacacggtacctgaaggaacgcccggtaaatcggaacccgaacggggtccccgttagttaacttaaccgttagggtgacggaaggaacggaagtccgggggacccccaaacggtaaaaccggttaaacctaacggccctaaagttcggggaaccggtttccggacgggggacccaaaacgggggaaccctaaccccgggg

SEQ ID NO: 423625 - DNA, 622 bp, Homo sapiens
  misc_feature: GZ8MTXP02IENGR.11.25.C03.1.454.CMB.2.raw
  modified_base (354)..(354): a, c, t, g, unknown or other
  modified_base (363)..(363): a, c, t, g, unknown or other
  modified_base (396)..(396): a, c, t, g, unknown or other
  modified_base (410)..(410): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggagggctgggagtgggtctcctttatttacagcagtgtagtanatattccgnagactccgtgcggggcattcaccatctccaganacaaactcgtaaanaacacgtctagtttacttacaaaattgaaacagtccctaggaacggacgaccgtatagaccgaacggggtccttaggttaactttaccggtggtacgacggtaggacggtacggtaccggggaccccaaacggttaaaccgttaactaaccgtacgtaaggtcgggaaccggttccgggacgggggaacccgtaaacgggggaccctacggg

SEQ ID NO: 423626 - DNA, 587 bp, Homo sapiens
  misc_feature: GZ8MTXP02GG4P0.11.25.C03.1.454.CMB.2.raw
  modified_base (453)..(453): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacatccagaactcccctgctctggaattgaattgagagataaatatacttgtggtatcaacagaagccaggccagtcccctgtattggtcatctatcaagatgtgaagcggccctcgagggactcccgtgacgcccgtattcctctcgggactccaaactcgtacgggaacggcagcccactctcgaccatcagccgggacccaggctagtggactgacgctgtaactattagttgtacagggtcgtcgggacnggcaagcaaccgtgtaccccggttaatcggttaccttcggggaaacgttcggggaaccctaaacggggtccctaaccggttccgtttaggacgttaccgaacggtacccccaaacggggcccctaaaacccccg

SEQ ID NO: 423627 - DNA, 607 bp, Homo sapiens
  misc_feature: GZ8MTXP02G7T9K.11.25.C03.1.454.CMB.2.raw
  modified_base (577)..(577): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctctgggttcaccgtcagtcacacctacatgagttgggtccgccaggctccgaggggaaggggcgtgggagtggggtcttaccttttatttacgagctaggtggtagtacatacttccgcagacctcggtgacgggggcctattccacctatcctccagacacctaaactcaaagacacgtcttacgttctacaaatgaacagctagagtgaccgatcgaacacggtccggttatacgttacgtgtgacggtaagcggaggtccgggggacccaacggttaaaccgttacgtaccgtacgtaacggttcgggaccgttcggngggggaacccgaacggggtaccctaccggg

SEQ ID NO: 423628 - DNA, 581 bp, Homo sapiens
  misc_feature: GZ8MTXP02GBXMX.11.25.C03.1.454.CMB.2.raw
  modified_base (360)..(360): a, c, t, g, unknown or other
  modified_base (387)..(387): a, c, t, g, unknown or other
  modified_base (391)..(391): a, c, t, g, unknown or other
  modified_base (459)..(459): a, c, t, g, unknown or other
  modified_base (485)..(485): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggccgcaggctcgaggggaggctggagtggtctctttattacagtcagtgtagtacattactccgnacgactccgtgacgggggcattcaccnttcnccagagacaactacaaagactaacgcttcgtttactacaaatcgaaactagcctagacgacgcctaancgaaccgacggtcgtagtacttacgngtagcgaggagtaggtcggggaccctaaggtaacctttacgacgtacaacggttcggaacgttcggacgggggacccgaaacggaccgtaaccggg

SEQ ID NO: 423629 - DNA, 813 bp, Homo sapiens
  misc_feature: GZ8MTXP02IP2SW.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctggaggaggcctgatccagccgtgggggtccctgagactctcctgtgcagcctcgtgggttcaccgtcagtcacacctacatgagttcggccgccaggcctccgaagggggaaggggcgtgggaggttcgggttccttaccttttatttacgagtcgtaaggttggtaagtactaagttacttcccgactacggaccgttccgggtagggaccggggggtcctaaacttcccaaccccgtaacttcccgtaccgaacggaaacgtaaacctaaaaccgttaacgtaaaacgaaaccctaaccgttacccgttttacggtttttaaccctttaaacgtaaaaacgttaccgaaaaccgtaacggtacccgttaaggaacgggtaaaccggacccggtaaagttaccggaaaccgtacccggggtaccgtttaaggttaaacttttaccggtgggttaggttaacgggaaaggtaacggtacggggttacccggggaaccccgtaaaacgggttaaccgtttaaccgtacggtaaccgttaagggtaccggggtaccggtacgggtacgggggtaaccccgaaaaccgggggtacccgtaaaccccggg

SEQ ID NO: 423630 - DNA, 576 bp, Homo sapiens
  misc_feature: GZ8MTXP02IBOEX.11.25.C03.1.454.CMB.2.raw
  modified_base (482)..(482): a, c, t, g, unknown or other
  modified_base (493)..(493): a, c, t, g, unknown or other
  modified_base (503)..(503): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtggggttcaccgtcagtcacacctacatgaggttcggtccgccaggctccgaggggagggctgggagtgggtcttctttattacagcagtggtagtacatactccgcagactccggtggacgggggcctattccaccatctacagacacaactcaaagacacgtcttgtttctacaaatcgaacacgcctagacgtagccgaatcgaacgacggtcgttntactttacggngtagacgagngtacggacggaccctaacgtaaccgttactacgataacggtcggtacgtcggacgggaccgaacggaccacgg

SEQ ID NO: 423631 - DNA, 644 bp, Homo sapiens
  misc_feature: GZ8MTXP02J3OGF.11.25.C03.1.454.CMB.2.raw
  modified_base (487)..(487): a, c, t, g, unknown or other
  modified_base (550)..(550): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaggagtccagtgtgaggtgcgtctggtggagtctggagaggcctgatccagccgtgggggtccctgagactctcctgtgcagcctcgtggttcaccgtcagtcacacctacatgaggttcggtccgccgaggcctcccggaagggggaagggcgttagggaggttcggtcttcctttattacagctagtgtagtacatacgttccgacacgactccggtagggacgggggcctaattccaactactccacagaacgaaaccaactactaaaacgaacctacgtcgtttacgtttacctacaaaacgttgaaaaccncggtcctaggaacgcgaccgtacgtacgaccgacgggtccgtagttaacttaccgtggaccgngaagacggtacggtcggggaacccctaacggtaccgtactacgtcgtaaggttacggacgttcgggacgggacccgaacggggaccctaccggg

SEQ ID NO: 423632 - DNA, 621 bp, Homo sapiens
  misc_feature: GZ8MTXP02HATSM.11.25.C03.1.454.CMB.2.raw
tcagcgagagataccacgaccggtgctcgatttagtagtgtagatttgggtttgggggagaggagcccagcactgggattcccaggtgtttccattcggtgatcagcactgaacacagaggactcaccatggagttttggctgagctgggttttccttgttgctattttaaaaggagtccagtgtgaggtgcgtctggtggagtcgtggaggaggcctgactccagccgtgggggtccctgagactctcctgtacagcctctggcttcaccttcacttacctagtggcatgcacgtcgggtccgccagactccgaggcgagggggctgggaggtgggtggctagtttagttacatagtgaagtaggtaaatagtagtacttctattcgagtaccgtccggtagaacgggtcgtacttccgaccgtcctaccgaagacgtacaaacgttccgacggcaaccgacgtactagtaactccgtagaactaaagtacgaaacacgtccaggacgagtacgagaacggacgtaccggtacgtggttacgtagttaacgtggtacgtaacgtaaagttacttaagtaacgtaaggtaggtacggtaccggttacgggggtcgtttacg

SEQ ID NO: 423633 - DNA, 605 bp, Homo sapiens
  misc_feature: GZ8MTXP02IWXIY.11.25.C03.1.454.CMB.2.raw
  modified_base (301)..(301): a, c, t, g, unknown or other
  modified_base (373)..(373): a, c, t, g, unknown or other
  modified_base (504)..(504): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtctgggaggaggcctgatccagccgtgggggtccctgagactctcctgtgcagcctcgtgggtcaccgtcagtcacacctacatgagttcgggccnccaggctccgaggggagggctggagtggtcttccgtttatttacgagcgagttggtagtacattacgtccgnacgtctcccggtggacgggggcctattccaccatctaccgagacgacaaactctaaagaacacgtcttgtttctaacaaatcgaacagcctagacgacgccgagtcgaacacggtccggtgtaacttacgngtgacggacgagaacggtcggggaccccacggtaaccgttaacctacgactaagtcgggtacggtccggtacggggaacccgacggggtaaccctaccggg

SEQ ID NO: 423634 - DNA, 686 bp, Homo sapiens
  misc_feature: GZ8MTXP02ILWVP.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtgggttcaccgtcagtcacacctacatgagttcgggccgccaggcctcgaggggaagggctgggaggtcggtcttccttttattacgagtcgagtggtatacattactcccgacacgtacctccggtgggacgggggtccgtacttaccgaccctacttccgtacccgaagaagaaccctaaactaccgtaaaagaaccaccgtacttgtttacttaacaaaatacgaaacacgtcctaggaacgacgacccgaagtaccggaaccgacgggtacccggttagttaagtttccgtggtgggaccgaaggtacggacgggtcgggggaaccccctaacgggttaaaccgttaaccgacgtacgttaaggtaccggggtaaccgttccgggtacgggggacccgaaacgggggaccctaaccgggg

SEQ ID NO: 423635 - DNA, 500 bp, Homo sapiens
  misc_feature: GZ8MTXP02FE3HX.11.25.C03.1.454.CMB.2.raw
  modified_base (312)..(312): a, c, t, g, unknown or other
  modified_base (332)..(332): a, c, t, g, unknown or other
  modified_base (346)..(346): a, c, t, g, unknown or other
  modified_base (353)..(353): a, c, t, g, unknown or other
tcagcgagagataccacgaccggtgctcgatttagtagtgtagatttgggttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatactgttggtatcaacagaagccaggccagtcccctgtattggcatctatcaagatgtgaagcggccttnagggatcctgagccgattcnctggctccaactcngggaacncagccatctgaccatcagcggacccaggctagtggatgaggctagactattattgtcagggcgtggggacagcagcactcgcccgttatgtcttcggaactcgggaccaacggtcacgtcgtgagtcagcccaacggccaaaccccg

SEQ ID NO: 423636 - DNA, 709 bp, Homo sapiens
  misc_feature: GZ8MTXP02JRX15.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtccctgagactctcctgtgcagcctcgtggtcaccgtcagtcacacctacagtgaggttcggtcccgcgacggcctccggaagggggaacggggcgtgggaggtggggtccttcctttatttacagtctaggtggtatacacttactccgcagacgtccggtaggcggggtcctattccaacctactcctaccgaagaacgaacctaaactaccgtaaaagaaccgtacgtctttacgttttacctaaaccgtaaaattcggaaaacctacggtacccgtagggaaccgacgtacccggtaagtaccggaaccgtaacccggggtcgttagttaacttacgtgggtacgacggaaggaacgtacggtaccgggggaaccctaaacgggtaaaccgttaactaccggacgttaaggtacggggtaccggttacgggaccgggggaaccctaaacggggggacccttaaccgggg

SEQ ID NO: 423637 - DNA, 616 bp, Homo sapiens
  misc_feature: GZ8MTXP02GRJS3.11.25.C03.1.454.CMB.2.raw
  modified_base (178)..(178): a, c, t, g, unknown or other
  modified_base (279)..(279): a, c, t, g, unknown or other
  modified_base (303)..(303): a, c, t, g, unknown or other
  modified_base (365)..(365): a, c, t, g, unknown or other
  modified_base (414)..(414): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggngtccagtgtgaggtgcgtcgtggtggagtcgtggaggaggcctgatccagccgtggggggtccctgagactctcctgtgcagcctcgtgggttccaccgtnagtcacacctacatgagtggcccncaggctcgaggggaagggctggaggtggtcttctttattacagcagtgtagtacatatccgnagactccgtggacggggccattcaccatctcagacgaacaactcaaaanacacgtcttgtttactacaaatacgaaacacgcctaggaacgagccgaagtcgaaccgaccgggtccgttagtaactttacgtgtacgacggaaggaggtacgtccgggggacccctaaaacgtaaaccggtttaactaccggactaaggttcgggacggttcggaccgggggaaaccaaacggggtaccctaaacccgggg

SEQ ID NO: 423638 - DNA, 615 bp, Homo sapiens
  misc_feature: GZ8MTXP02HP58Z.11.25.C03.1.454.CMB.2.raw
  modified_base (363)..(363): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataatatacttgttgtatcaacagaagccaggccagtcccctgtatgtcatctatcaagatgtagaagccggccctgagggactcccgtgagccgattctctcggctaccaactcgtagggaaacncacgccctactctcgaccctatccgacggccgggaacccagggtaccttagtggaagtggacggctaggtaacttatttagtttggacaggggtccgtaggggaaccagggaccaggactaccgtcggtaccccgtttaagtcggtttaccgttaccgggaaacgttacggggaacccgtaaacggtcccgtaacccggttgtttacggaacgttccgaacggtacccccgaaacggaccccaaaacccccg

SEQ ID NO: 423639 - DNA, 681 bp, Homo sapiens
  misc_feature: GZ8MTXP02HOW3C.11.25.C03.1.454.CMB.2.raw
  modified_base (176)..(176): a, c, t, g, unknown or other
  modified_base (300)..(300): a, c, t, g, unknown or other
  modified_base (361)..(361): a, c, t, g, unknown or other
  modified_base (390)..(390): a, c, t, g, unknown or other
  modified_base (395)..(395): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtctgggaggaggcctgatccagccgtgggggtccctgagactctcctgtgcagcctgtcgggttcaccgtcagtcacacctacatgagttcggcccncgaggcctccgaggggagggctggagtggtctctttattacagcagtgtatacatatccgnagtactccggagcggggctatccacatcncaganacaactcaaagactacgtcttagtttacctaaacaaagtacgaaacacgtaccgtaggaacggtacgaccgtaagtaccggaacccggtaccgggtaccgtttaagtaacgtttaccggtggtacggaacggtaacggaacgggttaccgggacccggggaaaccccgtaaaacggttaaaacccgttaaccgtaaccggtacgtaacggggttaccggggaacccgggttaccgggggaacccgggggaaaaccccgtaaaaccgggggtaacccccgtaccggg

SEQ ID NO: 423640 - DNA, 618 bp, Homo sapiens
  misc_feature: GZ8MTXP02G7BHN.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctcctgtgcagcctcgtgggttcaccgtcagtcacacctacatgagttggtccgccaggctccgaggggagggctggagtggtctcgtttattacagcagtggtagtacactacttccgacacgactccggtgggacgggggccctaattccgacctactccgtacccgaaggaacgaaccaaacttcaaacgaacctaacgtctttcgtttacttaacaaaattcgaaacagtccctagacgagcccgatacgaccgtaccggccgttagtactttacgtgtcgacgtagaggagtccggggaccaacgtaacgttacgtacgacttaagtcggacgttacgacgggggacctaaacggggaccctaaccggg

SEQ ID NO: 423641 - DNA, 644 bp, Homo sapiens
  misc_feature: GZ8MTXP02ISMKH.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggggttcaccgtcagtcacacctacatgagttgggtccgccaggcctccgaggggaaggggctgggagtgggtcttcctttatttacagcagtggtagtacatacttccgcagactccggtggcgggggcctattccacctatcctaccagacgaacaaactactaaagaacacgtctttgtttacttacaaattcgaaacacgtcctaggaacgtacgcccgaagtcgaaccaccggggtccgttagttaacgttacctggtcgaccggaaggtaggaacggttcgggggacccctaaacggtaaaccgtttaactaccggtacttaaaggtcggggaaaccgttcggtacgggggaccctaaacgggggaccctaacccgggg

SEQ ID NO: 423642 - DNA, 614 bp, Homo sapiens
  misc_feature: GZ8MTXP02FVPLE.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggttcaccgtcagtcacacctacatgtagtcggtccgccgaggcctaccgaggggaaggggcgtgggaggttggggttccttccttttatttacagtcaggtaggtagtacattacttccgctagactccggtaggcgggggccagttccacccatcctcaagagacaactacaaagaaccacgtcttgttcttacaaatgaacagcctagagacgaccgatacgaccgacggtcgtgttaatacctggcgcggagaggacggtccgggggacccaaacggtaaccgttaacgccgtacgtaagtcggaacggtcggtacgggggaccgaaacgggggacccgtaacccgg

SEQ ID NO: 423643 - DNA, 628 bp, Homo sapiens
  misc_feature: GZ8MTXP02ID0BY.11.25.C03.1.454.CMB.2.raw
  modified_base (381)..(381): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctcctgtgcagcctcgtgggttcaccgtcagtcacacctacatgagttcgggccgccaggctccgaggggagggctggaggtggtcttcctttatttacagcagttggtagtactatactccgacagccgttccggngggcgggggcctacgttccaaccctatctaccgaagaacgaacaaaccttactaaagaaccacgtcttacgtttacttaacaaaagtcgaacagtccctaggaggacgaccgagtcgaaccgtacgggccgttagtactttacgtcggtagacggtaagaggacggtcgggggaccctaacggtacgttaaccgtacgacgtaagtcggacggttcggacggggacccgaacggggaccctaccggg

SEQ ID NO: 423644 - DNA, 585 bp, Homo sapiens
  misc_feature: GZ8MTXP02JKMOH.11.25.C03.1.454.CMB.2.raw
  modified_base (302)..(302): a, c, t, g, unknown or other
  modified_base (442)..(442): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctggaggaggcctgatccagccgtgggggtccctgagactctcctgtgcagcctcgtgggttcaccgtcagtcacacctacatgaggttggtccnccaggctccgaggggagggctggagtggtcttcctttattacagcagtggtagtacatatccgcagactccggtgcgggggccagttccacctatcctaccagaacgacaaactctaaacgaacacgtcttgtttcttanaaatagaacaagcctagacgagccgatcgacacggctagtattacgtgtgcgaggagacggtcggggaccctaacgtaaccgttacgacgtacgtaagtcgggaccgtacggtcgggggacccaaacggggaccctaaccggg

SEQ ID NO: 423645 - DNA, 548 bp, Homo sapiens
  misc_feature: GZ8MTXP02HU95W.11.25.C03.1.454.CMB.2.raw
  modified_base (366)..(366): a, c, t, g, unknown or other
  modified_base (373)..(373): a, c, t, g, unknown or other
  modified_base (375)..(375): a, c, t, g, unknown or other
  modified_base (390)..(390): a, c, t, g, unknown or other
  modified_base (477)..(477): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagtcggtccgccaggctccgaggggagggctgggagtggtcttccgtttatttacagcagtgtagtacatattccgnagctcgngnggggcatcaccatcnccagacgaacaactactaaagacacgtcttcgtttactacaaatgaacagcctagacgagcgagtcgacgacggccgtgtaattcgngtgcgagagagtcgggacctacgaacgtactacgctaagtcgacgtcgtcgggaccgaacggaccgtacgg

SEQ ID NO: 423646 - DNA, 780 bp, Homo sapiens
  misc_feature: GZ8MTXP02F27UP.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgactccagccgtggggggtccctgagactctcctgtgcagcctcgtgggtcaccgtcagtcacacctacatgaggttcgggtcccgccgaggcctaccgaagggggaacggggtcgtaggggtaggtcggggtttccttccctttttaagtttaccgaggtccgtaaggtagggttaacgtacctaatttaccgttccccggactaacggtacccgttcccggggtacggggacggggggtcccctaactttacccaacccgtattaccctacccgaaggaaaccgaaaccctaaaacccgttaccgtaaaaacggaaaccctaacgttaccgtttacggtttttacctaaaccgtaaaattacggaaaacctacgggtacccctaggaacggacgacccggtagtacgaacccggacgggtcccgttagttaacttacgtgggtacgacgggaagacgggtacggtccgggggaacccccaaacggttaaacccgttacgaccgtacggtaagtccggggtaacgttcggaccgggggacctaacggggacccgtaccgg

SEQ ID NO: 423647 - DNA, 604 bp, Homo sapiens
  misc_feature: GZ8MTXP02F7N0A.11.25.C03.1.454.CMB.2.raw
  modified_base (362)..(362): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttggtccgccaggctccgaggggagggctggagtggtctcctttattacagcagtggtagtacatactccgnacgactccggtggcgggggccattccaccatctccagacgacaaactctaaagacacgtcttgtttctacaaatcgaaacagccctaggacgacgcccgatcgaaccgacgggtccgttagttaacttacgtgtgacggagaggacggtacgggggaccccaacggtaaccgttacgtaccggactaacggtcggaaccggttcgggtacggggaacccgaacgggggacccctaaccgggg

SEQ ID NO: 423648 - DNA, 573 bp, Homo sapiens
  misc_feature: GZ8MTXP02IUHME.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttcgggtccgccgaggcctccgaggggaaggggctgggagtgggtctcctttatttacagcagtggtatacatattccgcagactccggtgcgggggccagttccacctatctaccagacgacaactacaaagacacgtcttgtttctacaaatgaacagcctaggagacgaccgatacgacaccggtcgtgtacttcgtagtgacgagacgagtcgggggacccaacgtacgttacacgtctaagtcggacgtcggtcggggaccaacggggaccctacggg

SEQ ID NO: 423649 - DNA, 649 bp, Homo sapiens
  misc_feature: GZ8MTXP02FHK66.11.25.C03.1.454.CMB.2.raw
  modified_base (381)..(381): a, c, t, g, unknown or other
  modified_base (412)..(412): a, c, t, g, unknown or other
  modified_base (417)..(417): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtcctgagactctcctgtgcagcctcgtgggtccaccgtcagtcacacctacatgagttgggtcccgccgaggcctccgaggggaacggggcgtgggaggtcgggttccttccgttttatacagtcgagtggtagtacactacttccgnacgactccgtggcggggccattcgaccatcncaganaacaactacaaagacacgtctgtttactacaaagtacgaacacgtacctaggacggacgacccgtaagtacgaaccgacgggaccgttagtaacttaacggtgtacggacggaacggaaggtacggtaccgggggacccctaaacgggttaaaccgttaaccgtaaccgaccgttaagacggggtaccgtacggggtcgggggaacccaaaacgggggaccctaacccgggg

SEQ ID NO: 423650 - DNA, 624 bp, Homo sapiens
  misc_feature: GZ8MTXP02FXF7M.11.25.C03.1.454.CMB.2.raw
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatacaacagaagccaggcccagtcccctgtattggtcatctatacaagatgtgaacgccggccctgagggactcccgtagacgccgtacttctctcggctaccaactcgtacgggaacgcacgcctactctacgacccatccgacggtccgggacccaggacctagtggaatgacggtctaggtaacttagtttacgtttggacgtaggggtacggtcgggaacgacgcgaacgcctaacgtccggtacccgtttagttccggttaccgttacggggtaaaccgttacggggaaccctaaacggttcccgtaccggttaaccgttggaacgtcccgaaccggaccccgaaacggacccccaaaaccccg

SEQ ID NO: 423651 - DNA, 559 bp, Homo sapiens
  misc_feature: GZ8MTXP02HK5JT.11.25.C03.1.454.CMB.2.raw
  modified_base (305)..(305): a, c, t, g, unknown or other
  modified_base (339)..(339): a, c, t, g, unknown or other
  modified_base (359)..(359): a, c, t, g, unknown or other
  modified_base (367)..(367): a, c, t, g, unknown or other
  modified_base (429)..(429): a, c, t, g, unknown or other
  modified_base (439)..(439): a, c, t, g, unknown or other
  modified_base (466)..(466): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtctggaggaggcctgatccagccgtgggggtccctgagactctcctgtgcagcctcgtggttcaccgtcagtcacacctacatgagttcggccgccagcnccgagggagggctggagtggtcttctttattacngcagtggtatacatactccnagactcgngcggggccatccacatcacagagacaactactaaagacacgtcttgtttctacaaatgaacngctagagtancgatagacgacggtacctgtacttacngtcgacgaagaggtacgtccggggacctaacggtaacgttacgtacgtacgtaagtcgacggtacggcgggtaccgaacgggaccgtaaccgg

SEQ ID NO: 423652 - DNA, 583 bp, Homo sapiens
  misc_feature: GZ8MTXP02IJSBQ.11.25.C03.1.454.CMB.2.raw
  modified_base (177)..(177): a, c, t, g, unknown or other
  modified_base (366)..(366): a, c, t, g, unknown or other
  modified_base (446)..(446): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtgtccgtgtccccaggacagacagccagaactcccctgctctggaattgaattgagagataaatattacttgttggtatcaacagaagccaggccagtcccctgtatggtcatctatcaagatgtgaagcggccctcgacgggactccctgacgccgattctctggcctaccaactcgtcgggaacncgacgccactctcgacccatccgagcgggacccaggctacgtgatggagctagacttattattgtcgagggcgtgggacngacacgctacgtcgtcccgtttatcggttacgttaccggtaaaccgtacggggaacccgtaaacgggttccgtaaaccggttcgttacggaacggttaccaaccggaccccgtaaaccgggacccctaaaacccccg

SEQ ID NO: 423653 - DNA, 586 bp, Homo sapiens
  misc_feature: GZ8MTXP02IM0RS.11.25.C03.1.454.CMB.2.raw
  modified_base (512)..(512): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctctgtgcagcctcgtggttcaccgtcagtcacacctacatgagttcgggccgccaggcctccgaggggaacgggctggagtggtcttcctttattacagctagtgtagtacattactccgcagtactccgtggacgggggtccattccacctatctaccagacgacaaacgtactaaagaccacgtcttcgtttactacaaatacgaactacgcctagagacgaccgagtacgaccgacggtacgttgtacttacgtgtgacgtagngaggtcggggaccaacggtaacgttactacgactaagcggtacgtcggtacgggaccgaacgggaccgtaccgg

SEQ ID NO: 423654 - DNA, 556 bp, Homo sapiens
  misc_feature: GZ8MTXP02GJ0JA.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcgggtccgccaggctccgaggggaaggggctggagtgggtctcctttattacagcagtggtatacatatccgcagactccgtgcggggccattcaccatctccagacgacaactactaaagacacgtcttgttcttacaaatgaacagcctgacgagccgatcgacgacggccgtagtacttacgtgtagcgagagagtcggggacccaacggtaacgtacacgtactaagtcggacgttcgacggggaccaacgggacctacgg

SEQ ID NO: 423655 - DNA, 617 bp, Homo sapiens
  misc_feature: GZ8MTXP02IILJT.11.25.C03.1.454.CMB.2.raw
  modified_base (274)..(274): a, c, t, g, unknown or other
  modified_base (297)..(297): a, c, t, g, unknown or other
  modified_base (358)..(358): a, c, t, g, unknown or other
  modified_base (368)..(368): a, c, t, g, unknown or other
  modified_base (438)..(438): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctgggaggaggcctgatccaggccgtgggggtccctgagactctcctgtgcagcctgtggttcaccgtnagtcacacctacatgagtggccncaggctcgaggggaggctggagtggtctctttattacagcgagtggtagtacatactccgnacgctccggnggcggggcctatccaccatcacagacacaactacaagaacacgtcttagtttacaacaaaatcgaaaacncgtaccgtagaacgacgaccgagtacgaaccgacggttacgttagtacgttacgtgtacgacggaggtaacggtacggtacccggggaaccctaaacggttaaccgttaaccgtacggtacgttaaggtacgggtaccggtccgggtacggggaacccgaaacggggtacccgtaccgg

SEQ ID NO: 423656 - DNA, 649 bp, Homo sapiens
  misc_feature: GZ8MTXP02G2PF5.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggagtccagtgtgaggtgcgtcgtggtggagtctggaggaggcctgatccagccgtgggggtccctgagactctcctgtgcagcctcgtgggttcaccgtcagtcacacctacatgagttggtccgccaggctccgaggggagggctggagtggtctcctttattacagcagtgtagtacatactccgcagacctccgtgggacgggggcctagttccaccatcctaccaagaacgaaccaaactactaaacgaaacaccgtcttacgtttacttaacaaaaagttcgaaaacctacggcccttaggaaacgaccgacccgtaagtacggaaaccgaccgggtccgtaggtttaacttaacgtgggtagtaggaaggtaacggaggtacccgggggacccaaacggttaaaccgttacgaacgtctaagtcgggaacgtcggtacgggggacccaaacggggaccctaacccgggg

SEQ ID NO: 423657 - DNA, 643 bp, Homo sapiens
  misc_feature: GZ8MTXP02IWDFQ.11.25.C03.1.454.CMB.2.raw
  modified_base (375)..(375): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctaggaattgaattgagagataaatatacttgttaggtatacaacagaacgccaggccacgtcccctgtattggtcatctatcaagatgtagacgccgcctgaggactcccgtgacgcgtacttccgtcgtcggctaccaacgtcgtacgggaacncaccgcctactcacgaaccagtccgacggcccgggaacccagggtaccttaggtcggagtacgggaggtccgttaggtaactttagtttaagttggtaccgtagggggtccgttacggggacacggacgtaacggacctacgttaccgtacccgtttaagtcggttaccgtttacggggaaaccgtcgggtaacccgtaaacggttccgtaaacccggttgtacggtacgtaccgaaccgaccccgaaaccggacccctaaacccccg

SEQ ID NO: 423658 - DNA, 623 bp, Homo sapiens
  misc_feature: GZ8MTXP02G61NQ.11.25.C03.1.454.CMB.2.raw
  modified_base (552)..(552): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtcagtcacacctacatgagttcgggtccgccgaggctccgaggggaagggctggagtggtctctttattacagcagtggtagtacatatccgcaggacctccggtagggacgggggccctagttaccgaccctatcctaccaggaacgaaccaaactctaaaacggaaccacgtcttacggtttaccttaacgaaaattcgaaacctaggtcccttaggaacggtacgaccgtagtacggaaccgaacgggtccgtagtacttacgtgtgacgagagngtacgggggacccaggtaacttacacgctaagtcggacgttccggaggggacccaacgggaccctaccggg

SEQ ID NO: 423659 - DNA, 593 bp, Homo sapiens
  misc_feature: GZ8MTXP02JY6OM.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggtccgccaggctccgaggggaaggggctggagtgggtctcctttatttacagcagtgtagtacatattccgcagactccgtggagggggccattcaccatctccagagacaaactctaaagaacacgctgtttcttacaaatcgaaacagccctaggacgacgacccgagtacgaacgaccgggtccgttgtacttacgtggtcgacggaggacggacgtcggggacccgacgtaaccgttacgtaccgtacgtaagtcggaccgtcggtcgggggaccgtaacggggaccctaccggg

SEQ ID NO: 423660 - DNA, 698 bp, Homo sapiens
  misc_feature: GZ8MTXP02IML83.11.25.C03.1.454.CMB.2.raw
  modified_base (245)..(245): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactccctgctctggaattgaattgagagtaataaatntacttgttaggtatcaacagaagccaggcccagtcccctgtatggtcatctatacaagatgtagaacgcggccctcgacgggactcccgtgagtcccgtattctcgttcggctccacgtccgtgggaacgccacgccacgtcctacgtacccagttcccgaacggaccggggaacccccgaagggacccgtaagttcggggaacgtcgggacgggtacgttaggtaccttaagtttacgttagtcccggtaagggggtaccggttcgggggaaccaagggtccgaaacggtcgtaacccgttacggtcccccgttttaaggtccggtttaccgttaccggggtaaaccgtacgggggtaacccgtaaacggggttccccgtaaaccgggttccgtttaacggaccggttaccgaacccggacccccgtaaaacgggacccccgtaaacccccg

SEQ ID NO: 423661 - DNA, 638 bp, Homo sapiens
  misc_feature: GZ8MTXP02JUNMS.11.25.C03.1.454.CMB.2.raw
  modified_base (356)..(356): a, c, t, g, unknown or other
  modified_base (379)..(379): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctgggaggaggcctgatccagccgtggggggtccctgagactctcctgtgcagcctgtcgggttccaccgtcagtcacacctacatggaggttcggtccgccaggctccgaggggaacgggcgtgggagtgggtcttcctttatttacngcagtggtagtacatacttccgnagactccggtggcggggcctattccaccatctaccaagacgaacctaaactactaaagaacacgtcttgtttactaacaaaatgaaacctagccctaggacgacgaccgatacggaccgaccggtccgttagtacttacgtgtcgacggtaaggacgacggtccgggggaaccccaaacggttaacccgttaacctaaccggcttaaggcggtaacggtcgggtacgggggacccgaaaacggggccctaaacccgggg

SEQ ID NO: 423662 - DNA, 614 bp, Homo sapiens
  misc_feature: GZ8MTXP02I848D.11.25.C03.1.454.CMB.2.raw
  modified_base (364)..(364): a, c, t, g, unknown or other
  modified_base (372)..(372): a, c, t, g, unknown or other
  modified_base (374)..(374): a, c, t, g, unknown or other
  modified_base (389)..(389): a, c, t, g, unknown or other
  modified_base (394)..(394): a, c, t, g, unknown or other
  modified_base (420)..(420): a, c, t, g, unknown or other
  modified_base (432)..(432): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctcctgtgcagcctcgtggtcaccgtcagtcacactacatgtagtcggtccaccgagctaccgaggggaaggcgtggaggtcggtccttctttaattacagctagtgtagtacatactcgnagactcgngnggggcatcaccatcncaganacactcaaagacagtcttgttactanaaactgaaaccnggacctagaagacgccgagtagaacccgtacgggccgttggtaacttactgggtacgacggaacggaggtacgtccgggggaaccctaaaccgggtaaccgttaaacctacggacctttaaagcggggtaaaccgttcggggaccgggggaaacccgaaacgggggtaacccctaacccggg

SEQ ID NO: 423663 - DNA, 586 bp, Homo sapiens
  misc_feature: GZ8MTXP02ID34O.11.25.C03.1.454.CMB.2.raw
  modified_base (434)..(434): a, c, t, g, unknown or other
  modified_base (465)..(465): a, c, t, g, unknown or other
  modified_base (508)..(508): a, c, t, g, unknown or other
tcagcgagagataccacgaccggtgctcgatttagtagtgtagatttggggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtgggaggaggcctgatccagccgtggggggtccctgagactctcctgtgcagtcctcgtgggttccaccgtcagtccacacctacatgagtcgggtcccgccgaggcctccgaaggggaggggctgggaggtgggtctcctttattacagcagtggtatactatacttccgcagactccggtggcggggccattccacctatcaccagacaacaactacaaagaacncgtcttagtttacctaacgaaaatcgaaacncggcctagagacgccgaatcgacgacggtcgtgtactacgtgngcgagagtagccgggacccaacggtaactactacgctaaggtcggacgttcggacgggaccgaaacgggacctaccgg

SEQ ID NO: 423664 - DNA, 743 bp, Homo sapiens
  misc_feature: GZ8MTXP02IBCLR.11.25.C03.1.454.CMB.2.raw
  modified_base (601)..(601): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccagccggtggggggtccctgacgactctcctgtgcagcctgtgggttcaccgtcagtcacacctacatggagttcggtccgccagggctaccggagggggaacgggcgtgggaggttcgggttcttacctttttattacgagcgtaaggttggtagtacattacgtccgacacggtactccggtgggacgggggcctaattacccactactccgtaccgaagacgaactaaacctacgtaaaacgacccgtaccgttctttaacggtttttacctaaacaaaacgtcgaaaaccgtcggtcccttagggaaacggacgcccggtaaagtaccgggtaaccggacccgggtaccggttattaacgttttaccggnggtacgacgaaggacggtacgggtaccggggaaacccctaaacgggttaaaccgttaccgtaacggtacggttaacggttaccggggtaaccggttaccggggtaccgggggaaacccggaaaccgggggtaccccgtacgg

SEQ ID NO: 423665 - DNA, 678 bp, Homo sapiens
  misc_feature: GZ8MTXP02F4H9J.11.25.C03.1.454.CMB.2.raw
  modified_base (386)..(386): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgaggttcgggcccgccgaggcctaccgagggggaaggggctgggaggtcgggttcttccttttaattacagctaggtggtagtacattactccgnacgacctccggtggcgggggcctattccacctatcctaccgagaacgaccaaacttacaaaagaactacgtcttcgtttacttaacaaaatacgaaacacggcctaggaacggacgacccgtaagtacggaacccgtacggggtccgttaggtttaaacttacgtggtggaaccggtaggaagggtacggtacccgggggaaacccctaaacgggttaaaccgtttaccgacggtacctaaggtcgggaaccgttcgggaccggggaccgtaaacggggaccctaacccggg

SEQ ID NO: 423666 - DNA, 805 bp, Homo sapiens
  misc_feature: GZ8MTXP02JM9DS.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtcgtgggaggaggcctgactccgaggccgtcggggggtccctgacgtactctcctgtcgcacgtcctcgtcggttcaccgtcagtcacacctacagtcggaggttcgggcccgccgacggcctaccggagggggaacggggtcgtggggtaaggttcgggttcctttaccgttttaagtttaccgagtacgtaggttggtaaacgtactaacgttaccgttacccgacgtaacggtacccgtaccgggtacgggaccgggggtacccttacgttaccccgaacccgtacttacccgtacccgaaacgggtaaacgaaaccctaaacccgtttaaccgaaaacggaaacccgttaacccgggtactttttaacggtttaaccctttaaaaccgaaaagttaccggaaaaccgtaccggtacccgttaagggaaccggacccgggtacccgtagtaaccgggaaaccgtcccgggttacccgttagttacttaacggtggtacggaacggtaaggacggtacggtacccggggacctaacggtaaccgtacgtacgtacgtaagtcggtacgtcggtacggacccgaacggtacccgtaccgg

SEQ ID NO: 423667 - DNA, 581 bp, Homo sapiens
  misc_feature: GZ8MTXP02J17R4.11.25.C03.1.454.CMB.2.raw
  modified_base (300)..(300): a, c, t, g, unknown or other
  modified_base (319)..(319): a, c, t, g, unknown or other
  modified_base (340)..(340): a, c, t, g, unknown or other
  modified_base (372)..(372): a, c, t, g, unknown or other
  modified_base (447)..(447): a, c, t, g, unknown or other
  modified_base (494)..(494): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtggaggaggcctgatccagccgtggggggtccctgagactctcctgtgcagcctcgtgggttcaccgtcagtcacacctacatgagttggccnccaggctcgagggagggcnggagtggtctcctttattacngcagtggtagtacatactccgcagactccggngacgggggccaattccaccatcctccagacgaacaaactctaaagaacacgcttagtttcttacaaatcgaaacngacctgagacgaccgatcgaacacgggtccgttagtacttacgtggngacgagaggcggaccgggacctaacggtaaccgtacgtacgacgtaagtcggtaccgtcgggaccgggaccgaaacgggacctacgg

SEQ ID NO: 423668 - DNA, 629 bp, Homo sapiens
  misc_feature: GZ8MTXP02I0RWM.11.25.C03.1.454.CMB.2.raw
  modified_base (275)..(275): a, c, t, g, unknown or other
  modified_base (287)..(287): a, c, t, g, unknown or other
  modified_base (324)..(324): a, c, t, g, unknown or other
  modified_base (355)..(355): a, c, t, g, unknown or other
  modified_base (364)..(364): a, c, t, g, unknown or other
  modified_base (375)..(375): a, c, t, g, unknown or other
  modified_base (537)..(537): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtnagtcacacctantgagttcggccgccgaggctccgaggggagggctggngtgggtcttcctttattcagcagtgtagtanactatccgnacgactccggngcgggggccattccacctactcgtaccagacgacaactacaaacgaacctacgtcttcgtttacttaacaaaagtacgaaactacggaccctaggaaagtaccggacccgattacggaccgtacccgggccgttagttaaacttcgtggtcgaggtaacggngtaacggtcggggaaccctaacggtaaaccgttcgtaaccgctaaggtccggacggttccgggacgggaacccggacggggaccctaaccgg

SEQ ID NO: 423669 - DNA, 603 bp, Homo sapiens
  misc_feature: GZ8MTXP02JPS8F.11.25.C03.1.454.CMB.2.raw
  modified_base (372)..(372): a, c, t, g, unknown or other
  modified_base (382)..(382): a, c, t, g, unknown or other
  modified_base (398)..(398): a, c, t, g, unknown or other
  modified_base (401)..(401): a, c, t, g, unknown or other
  modified_base (414)..(414): a, c, t, g, unknown or other
  modified_base (478)..(478): a, c, t, g, unknown or other
  modified_base (499)..(499): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtcccgcgaggcctaccgaggggaagggctgggagtgggtctcctttatttacagcagtggtagtacatactccgnagactccggnggcggggccatcaccntcncagacacaaactnaagaacctacgcttgtttactacaaaatcgaaacacgcctaggaacgacgccgatacggaaccncgggccgttaggttattacgnggtcgacggagacggaggtccgggggacccacggtaaacgtttccgaacgctaaggtcggggaccgttcgggacgggggacccaaacgggggccctaaccgggg

SEQ ID NO: 423670 - DNA, 622 bp, Homo sapiens
  misc_feature: GZ8MTXP02HWQ63.11.25.C03.1.454.CMB.2.raw
  modified_base (324)..(324): a, c, t, g, unknown or other
  modified_base (512)..(512): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtctgggaggaggcctgactccagccgtggggggtcctgagactctcctgtgcagcctcgtggttcaccgtcagtccacacctacatgagttcggccgcaggctcgaggggagggctggngtggtctctttattacagcagtggtatacatactccgcagactccggtggcgggggcctattccacctatcctacaagacgaccaaactactaaagaacacgtcttacgtttactaacaaaatcgaaactacgccgtagaacgacgacccgaagtccggaaccgaccggtccgttagttaacttacgnggtcgacggagaggacggtccgggggacccctaaacggtaacccgtttaacgacgtacgtaagtcgggtaccggtcggtacgggggaccgtaacggggaccctacccggg

SEQ ID NO: 423671 - DNA, 616 bp, Homo sapiens
  misc_feature: GZ8MTXP02F1ASB.11.25.C03.1.454.CMB.2.raw
  modified_base (374)..(374): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtcctgagactctcctgtgcagcctcgtgggttcacgtcagtcacacctacatgagttcgggtccgccaggcctccgaggggaaggggctgggagtgggtcttcctttattacagcagtggtaagtacatacttccganacgactccgtggacgggggccaattccgaactctctccaagacaacactacaaagaacacgctgtttactacaaatacgaaacagacctagaacggagacccggaatacggaacctaacgggccccgttaggtattaccgtggtacgcggaagacgtaggtcggtccgaccctaacggtaaccgttaacgtaaccgtcgtaacgtcggaacggttcgaccgggggaccaacgggggaacccc

SEQ ID NO: 423672 - DNA, 611 bp, Homo sapiens
  misc_feature: GZ8MTXP02F6TQI.11.25.C03.1.454.CMB.2.raw
  modified_base (343)..(343): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttggtccgccaggctcgaggggaggggctggagtggtctctttattacagnagtggtagtacatacttccgcagacctccggtggacgggggccgattccacctatctccagacgaacaaactctaaagaacacgtctacgtttactacaaatacgaacagccctaggagacgaccgtatacgaccgacgggtccgtagttaacttacgtagtgacgtacggagacggtcgggggacccctaacggtaaacgttaaccgtacggtactaagtacgggaaccgtcggtacgggggacccgaaacggggacctaacccggg

SEQ ID NO: 423673 - DNA, 559 bp, Homo sapiens
  misc_feature: GZ8MTXP02FPM6G.11.25.C03.1.454.CMB.2.raw
  modified_base (299)..(299): a, c, t, g, unknown or other
  modified_base (360)..(360): a, c, t, g, unknown or other
  modified_base (371)..(371): a, c, t, g, unknown or other
  modified_base (385)..(385): a, c, t, g, unknown or other
  modified_base (388)..(388): a, c, t, g, unknown or other
  modified_base (394)..(394): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtcgtggaggaggcctgatccagccgtggggggtccctgagactctcctgtgcagcctcgtgggttcaccgtcagtcacacctacatgagttgggtccnccaggctccgaggggagggctggagtggtctctttattacagcagtgtatacatattccgnagactccgtgnggggccattcaccntcnccaganacaactacaagaacacgctgtttctacaaatgaacagcctagagacgccgatcgaaccacgggtccctagtacttactggtgacggagagacgtcgggggacccaaggtaaccgttacacgctaagtcgggacgtcgtaggggaccaagggggaccctaaccggg

SEQ ID NO: 423674 - DNA, 536 bp, Homo sapiens
  misc_feature: GZ8MTXP02JT16Z.11.25.C03.1.454.CMB.2.raw
  modified_base (370)..(370): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgtggtatcaacagaagccaggccagtcccctgtattggtcatctatcaagatgtagaagccggccctgagggactccccgtgagccgtattctcgtcggcctccaactcgtacggggaacncagccactctgacccatcgacggaccgggacccaggctagtggaatggaggctaggacttattacgttgtcgagggcgtgggacaggcagcacgtcgcccgttatcgttctacggaacgtcgggaccaaggtccacgtctgactcgacgaccaacggcctaacccg

SEQ ID NO: 423675 - DNA, 579 bp, Homo sapiens
  misc_feature: GZ8MTXP02G3SUH.11.25.C03.1.454.CMB.2.raw
  modified_base (272)..(272): a, c, t, g, unknown or other
  modified_base (285)..(285): a, c, t, g, unknown or other
  modified_base (398)..(398): a, c, t, g, unknown or other
  modified_base (416)..(416): a, c, t, g, unknown or other
  modified_base (509)..(509): a, c, t, g, unknown or other
  modified_base (543)..(543): a, c, t, g, unknown or other
  modified_base (558)..(558): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtctggaggaggcctgatccagccgtgggggtccctgagactctcctgtgcagcctctgggttcaccgtnagtcacacctacntgagttggccgcaggctccgaggggagggctggagtggtctctttattacagcagtgtagtacactatccgcagactccggtgcgggggccattccgacctatcctaccaganaccaaactcaaagaaccncgtcttgtttactacaaaatcgaaacaggtccctaggaacgtacgccgaatcgaaccgtacgggccgttagttattacgtgtgcgtaaggagnggtccggggaccctaacggtaaacgttctaacgntcgtggacgttcggnggggacccaggggacctcggg

SEQ ID NO: 423676 - DNA, 584 bp, Homo sapiens
  misc_feature: GZ8MTXP02FW96J.11.25.C03.1.454.CMB.2.raw
  modified_base (262)..(262): a, c, t, g, unknown or other
  modified_base (285)..(285): a, c, t, g, unknown or other
  modified_base (334)..(334): a, c, t, g, unknown or other
  modified_base (354)..(354): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgatccagccgtggggggtccctgagactctcctgtgcagcctntgggtcaccgtcagtcacaccanatgagttggccgcaggctcgaggggaggctggagtggtctctttatacngcagtgtatacatactccgnagcctcggtggacgggggcattcaccgatctaccagacgaaccaaactctaaagaacacgcttgtttacttacaaatgaaactagcctggaacgacgccgaagtacgaccgaccgggtcctaggttactaacgtggtcgacgaggagtaacggtcggggaccctaacggtaaccgttactacggactaagtcggaacggttcgacggggaccgaaacgggccctaacggg

SEQ ID NO: 423677 - DNA, 588 bp, Homo sapiens
  misc_feature: GZ8MTXP02IO4CL.11.25.C03.1.454.CMB.2.raw
  modified_base (342)..(342): a, c, t, g, unknown or other
  modified_base (399)..(399): a, c, t, g, unknown or other
  modified_base (418)..(418): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggccgccaggctccgaggggagggctggagtgggtctcctttattacngcagtggtagtcatattccgcagctccggtgcgggggcctatccaccatctccaganacaactacaaagacacgtnttcgtttacttacaaatgaacacgtcctagagagccgtatacggaccgacggtccggtagttacttacgtagtcgcggtaacgaggacggtcggggaaccccaaggtaaccgttaacctaggccttaagcgggtaccgtcggtagggacccgtacgggggaccctacggg

SEQ ID NO: 423678 - DNA, 595 bp, Homo sapiens
  misc_feature: GZ8MTXP02GTAFY.11.25.C03.1.454.CMB.2.raw
  modified_base (299)..(299): a, c, t, g, unknown or other
  modified_base (363)..(363): a, c, t, g, unknown or other
  modified_base (373)..(373): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtgggttcaccgtcagtcacacctacatgagttgggccnccaggctccgaggggagggctggagtggtctcctttattacagcagtggtagtacatactccgnagactccggnggacgggggccattccacatctccagagacaactctaaagaacacgtcttgtttactacaaatacgaactagcctgacgagccgatacgaccgacggccgttagtacttcgtgtagcggaagacggaacggtccgggggacccctacggtaaaccgttaccgtacggtctaaggtcgggtaacggtcggtaccgggggaccaaacgggggccctaacccggg

SEQ ID NO: 423679 - DNA, 588 bp, Homo sapiens
  misc_feature: GZ8MTXP02FHD89.11.25.C03.1.454.CMB.2.raw
  modified_base (358)..(358): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttgggccgcaggctccgaggggagggctggagtggtctctttatacagcagtggtatacatatccgnagactccggtggcggggccgattccaccatcctaccgagacgactaaactctaaagacacgtctgtttctacaaatacgaacagcctaggagacgccatacgaccgacggtccgttgttattacgtggtgacgagacgacggtcgggggaccccaacggtaaccgtttacgacgtacgtaagtcggggtaccgtcgggtcggggacccgaaacgggggaccctaaccggg

SEQ ID NO: 423680 - DNA, 603 bp, Homo sapiens
  misc_feature: GZ8MTXP02HFJI3.11.25.C03.1.454.CMB.2.raw
  modified_base (363)..(363): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttcggccgccaggctccgaggggaagggctggagtggtcttctttattacagcagtgtagtacatacttccgnagtacctccggtggcggggccattccaccatccaccagacgacaaactactaaacgaacacgtcttcgtttactaacgtaaatcgaaacacgcctagacgacgaccgagtcgaaccgacggtcgttagttacgttacgtgtcgacgaaggacggaggtccggggacccaaacggtaaccgttaccgtacgtactaacgtcgggacgttcggacggggaccaacggggtaccctaaccggg

SEQ ID NO: 423681 - DNA, 620 bp, Homo sapiens
  misc_feature: GZ8MTXP02G6BFD.11.25.C03.1.454.CMB.2.raw
  modified_base (260)..(260): a, c, t, g, unknown or other
  modified_base (305)..(305): a, c, t, g, unknown or other
  modified_base (362)..(362): a, c, t, g, unknown or other
  modified_base (441)..(441): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgatccagccgtgggggtccctgagactctcctgtgcngcctcgtgggttcaccgtcagtcacacctacatgagttcgggccncaggctcgaggggagggctggagtggtctctttattcagcagtgtatacatatccgnagactcgtggcggggcctatccactctcaccagacgaacaactactaaagaactacgtcttgttactacaaatgaaacngcctagagacgccgatcgaaccgcggtaccgttgtaacgttacgtggtacgacggaagacgggacggtcccgggggaacccctaaacggtaaacccgtttacgtaaccgtacgttaacggtacgggtaccggttaccggggtaccggggaacccggaaaccgggggaccctacccgggg

SEQ ID NO: 423682 - DNA, 703 bp, Homo sapiens
  misc_feature: GZ8MTXP02I1TUP.11.25.C03.1.454.CMB.2.raw
  modified_base (365)..(365): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcaccccactacatgagttcgggccgccaggctccgaggggagggctggagtggtctctttattacagctagtggtatacatatccgnagacctccggtggacgggggcctattccaccatctcagacgaacaactactaaagaaccacgtcttacgtttactaacaaaagttacgaaacctacggtcccttaggaaacggacggtacccgaagttacggaaccccgtacggggtcccgtttagggtttaactttaaccggttagggttcgggaccggtaaagggtacgggtacgggttacccgggggaaaccccctaaacggggttaaacccgttaaccgttaccggtaccgttaacggtacggggtaacccggtttccggggtaccgggggaacccgaaacgggggtaaccccgtaacccgggg

SEQ ID NO: 423683 - DNA, 631 bp, Homo sapiens
  misc_feature: GZ8MTXP02IM0HV.11.25.C03.1.454.CMB.2.raw
  modified_base (298)..(298): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctctgtgcagcctctgggttcaccgtcagtcacacctacatgagttcgggccnccaggctccgaggggaagggctgggagtcgggtctcctttattacagcagtggtaagtacattactccgcagacctccggtggacgggggcctattccacctatctaccagacgacaactctaaagacacgtcttgtttctacaaatacgaacagccctagacgtacgaccgagtaccgacgaccgggtccgttagttaacttcgttagtcggacggtagaacggtacggtaccgggggaaccccaaccgggtaaaccgttaaccgtacggtaccgttaagtcgggtaaccggttcggtacgggggaccctaaacggggaaccccgtaccggg

SEQ ID NO: 423684 - DNA, 559 bp, Homo sapiens
  misc_feature: GZ8MTXP02JZZKJ.11.25.C03.1.454.CMB.2.raw
  modified_base (338)..(338): a, c, t, g, unknown or other
  modified_base (357)..(357): a, c, t, g, unknown or other
  modified_base (364)..(364): a, c, t, g, unknown or other
  modified_base (377)..(377): a, c, t, g, unknown or other
  modified_base (380)..(380): a, c, t, g, unknown or other
  modified_base (399)..(399): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttggccgcaggctcgaggggagggctggagtggtctctttattacngcagtgtatacatatccgnagctcgngcggggcatcacntcncagacacaactctaagacncgtcttgttctacaaatgaaacagcctgacgacgccgagtcgacgcggtaccgtgttacttacgtggtgacggtagacggaggtccggggacccaacggtaacgttacgacgtactaagtacgggacgtcggtaccggggaccgaaacggggcctaccgg

SEQ ID NO: 423685 - DNA, 609 bp, Homo sapiens
  misc_feature: GZ8MTXP02J0H9G.11.25.C03.1.454.CMB.2.raw
  modified_base (499)..(499): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtattggtcatctatcaagatgtgaagccgggaccctcgaggggactccccgtagacgtcccgtatttcctactcggcctacccaaacttccgtagggaaaccggcagcccactctcgaccactcacgggaccgggacccaggctactgggaatgggagtctagactttagttattgtacgagggcgtagggacagcgacgctacgtcgacccgtttntcggttcgttaccgggaaccgtacggggtacccgaacggtacccgtaaccggttcgtttacgggacgttcccgaaaccggccccgaaaaccgggacccctaaaacccccg

SEQ ID NO: 423686 - DNA, 626 bp, Homo sapiens
  misc_feature: GZ8MTXP02JMR3Z.11.25.C03.1.454.CMB.2.raw
  modified_base (254)..(254): a, c, t, g, unknown or other
  modified_base (286)..(286): a, c, t, g, unknown or other
  modified_base (384)..(384): a, c, t, g, unknown or other
  modified_base (405)..(405): a, c, t, g, unknown or other
  modified_base (413)..(413): a, c, t, g, unknown or other
  modified_base (423)..(423): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcngcctcgtgggttcaccgtcagtccacacctanatgagttcggccgcaggctccgaggggacgggctgggagtgggtcttcctttattacgagtcagtggtagtacactattccgcagtacctccggtggngggggtcccattccaccatcnccaagganactaaacgtntaaacgacaccgtcttgtttacctacgaaatacgaaacacggtcctaggaacgagcccggaatacgaccgtaccggtccgtagttatacgtagtacgcggtaaagggacgtacggtccgggggacccaacgggtaaaaccgtttcgacgcttaaggtcgggtaaccgtcgggtaggggaacccaacgggggtaaccacccggg

SEQ ID NO: 423687 - DNA, 662 bp, Homo sapiens
  misc_feature: GZ8MTXP02GRZOB.11.25.C03.1.454.CMB.2.raw
  modified_base (294)..(294): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggtcaccgtcagtcacacctacatgagtggccncaggctcgagggaggctggagtggtcttctttattacagcagtgtagtactatacgttccgacacgtaccgtccggtagggacgggggccctagttccaaccctattccctacccgaaaggaacgtaaacctaaaccgttaccaaaaagaacctacgtaccttacgttttacctaacaaaattacgaaaccgtaagccctaaggaacgtacggcccgtaaagtcggaaacccgtacgggcccggttagttaacttaccgtggtcgaacggaggaacggtacggtccggggaacccctaaacggtaaccgttaacctcgacgtaagtcggtaacgtcggacggggacccgaaacgggacccgtaaccgg

SEQ ID NO: 423688 - DNA, 712 bp, Homo sapiens
  misc_feature: GZ8MTXP02HIZH3.11.25.C03.1.454.CMB.2.raw
  modified_base (354)..(354): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtctggaggaggcctgatccagccgtggggggtccctgagactctcctgtgcagcctcgtgggttcaccgtcagtccacacctacatgaggttcggccgccaggcctccgaggggaacgggctgggagtcgggttcttccgtttattacgngcagtggtagtacattatccgcagcctccggtggacgggggcctagttccacctatccctaccgaaggacgaaacctaaacctacgtaaaacgaaccacgttaccgtttgtttaccttaaaccgaaaattacgaaacccgtaagtccccgttaaggaacggtacgtacccggaagttaccggaaacccgtacccgggggtacccgttagtttaaaacgtttaccggtgggtaccggacggtaaaaggacggtaggtaaccgggggacccctaaacggtaaaccgttaccgtaaccgagttaaacggtcgggtaaccgtccggtacgggggaacccgaaacggggtacccctaaccggg

SEQ ID NO: 423689 - DNA, 649 bp, Homo sapiens
  misc_feature: GZ8MTXP02F1Z85.11.25.C03.1.454.CMB.2.raw
  modified_base (344)..(344): a, c, t, g, unknown or other
  modified_base (365)..(365): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagctctcctgtgcagcctcgtgggtcaccgtcagtcacacctacatgagttcgggtccgccgaggctccgaggggaagggctggagtggtcttctttattacngcagtgtagtacatactccgnacgactccggtggcgggggcctattccgacctagtcctccgaagaacgaacctaaactacgtaaaacgaacctacgtcttcgttttaccttacaaaagtcgaaaccgacgtaccctagggaaagcgacccgtaagtcggaacccgtaccgggcgttacgttaattaccgtgtagcggaaaggtacggacgggttccgggggacccctaaaacgggtaaccgtttaccgtacgacgtaagtcgggaacgtccggtcgggggaaccctaacgggggaccctacggg

SEQ ID NO: 423690 - DNA, 680 bp, Homo sapiens
  misc_feature: GZ8MTXP02HOLU0.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgaggttcggccgccgaggcctccggaagggggaggggctgggaggttcgggtcttaccttttatttacgagtcgagtggtaagtacatactccgcacgtacgtccggtgggcggggtcctattccacctatcctcgaagacgaccaaacttacaaaacgaacctcgtactttagttttacctaacaaaagtacgaaacctacgtaccgttaggaaacggaccgtacgaacggtacgaaacccggtaccggggttaccgttaaggtttactttacgtgggtacgacggtaaggacggtacggttccgggggaccctaaacggttaaccgttacgtacgcgttaaggtcggtaccggttcgggacgggacccgaaacggggtaccctaaccggg

SEQ ID NO: 423691 - DNA, 561 bp, Homo sapiens
  misc_feature: GZ8MTXP02FKDRA.11.25.C03.1.454.CMB.2.raw
  modified_base (377)..(377): a, c, t, g, unknown or other
  modified_base (459)..(459): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatggagttcgggtccgccgaggcctccgaggggaacggggctgggagtggggtctccttttattacagtcagtggtagtacatacttccgnagactccggtggagggggccattcaccatctccagacacaactacaaagacacgtctgtttctacaaatgaacagcctgacngccgatgaccgcggtcgtgtattacgtgtgcgagagacgtcggggacccagtaccgttacgacgctaagtcggaacgtcggcgggaccgaacggacctacgg

SEQ ID NO: 423692 - DNA, 736 bp, Homo sapiens
  misc_feature: GZ8MTXP02FQOVJ.11.25.C03.1.454.CMB.2.raw
  modified_base (178)..(178): a, c, t, g, unknown or other
  modified_base (257)..(257): a, c, t, g, unknown or other
  modified_base (259)..(259): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggngtccagtgtgaggtgcgtcgtggtggagtcgtgggaggacggcctgatccagccggtgggggtcctgagactctctgtncncgcctcgtggtcaccgtcagtccacacctacatggtaggttcggccgccgaggcctaccggaggggacgggtcgtggggtaggttcggggtcctttccttttaagtttaccgaggtaccgtaggttaggtaacgttaactaacgtttaccgttcccgacgaacggtaccgtccgggttaggggaccggggggtccctaactttacccgaaccctacttacccgtaccgaagaaacgtaaacctaaacctacgtaaaacgaaccgtaccgttacttcgttttaactaactaaagtacgaaacgacgtccgtagacggacgccgtaagtacgaccgtaccggtcgttagttaacgttaccgtagtacggacggtaaggtacggacggttaccggggacccgtaaaccgtaaaccgttaccgtacgtacgtaaggtcggacggttaccggacgggaaccggaaccgggacccgtacccgg

SEQ ID NO: 423693 - DNA, 700 bp, Homo sapiens
  misc_feature: GZ8MTXP02ILPM5.11.25.C03.1.454.CMB.2.raw
  modified_base (258)..(258): a, c, t, g, unknown or other
  modified_base (336)..(336): a, c, t, g, unknown or other
  modified_base (400)..(400): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtcccaggacagacagccagaactccctgctctggaattgaattgagagataaatatacttgttgtatcaanagaagccagccacgtcccctgtacttggtctatcttaatcaagtatggtagaagccgggccctagacgggactcccgngacgcctattctcgtcggtcctaccactcgggtcggaacgcgtacgcctctacgtacgactacnccgacgaccgggaccgagtacgtacgtaggtcgtaggtacgtcgtacggtactttaacgtttaagtttcggtaaccgggttaggggtacgggttacgggaacggtacggacgtacggtaccgttaaccggtcggttccccgtttaacgtttccggttaccggggtttaaccggttaaacccgggacggggttaacccggtaaaccgggttacccgtaaccgggttttaaccgtacgggttaaccgttacccggtaaacccgtaccccggaaaaccgggttaaccccctaaaaccccccgg

SEQ ID NO: 423694 - DNA, 655 bp, Homo sapiens
  misc_feature: GZ8MTXP02GOO3T.11.25.C03.1.454.CMB.2.raw
  modified_base (247)..(247): a, c, t, g, unknown or other
  modified_base (266)..(266): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcgtggtttcgtgtagctatttaaagagtcagtgtgaggtgcgtctggtggagtctggaggaggcctgatccagccgtgggggtccctgagctctcctgtgacncgtcctcgtcggtcacgtnacgtcacactatagtgtacggtcggccgcgacggcgacggaggggaggcgtagggtaggttcggttcctttactttacgttacgagtacgtaggttacgtacgtactaccgttacgtccgacgacgtaccgttcggacggggcggggtcctactaccacctacgtaccgtacgaacgacgaacctaaacgtactaaacgaacctacgttactttacgtttactaaacgaaagtacgaacgacgtacgtacgacggacgacgtacgtacgacgacggtacgtacgttacgttacgtagtacgacgacgacggacggtacggtaccgtaacgtacgtacgtacgtacgtaacgtacggtacggtacggtacggaccggaccggacgtaccg

SEQ ID NO: 423695 - DNA, 635 bp, Homo sapiens
  misc_feature: GZ8MTXP02GNP5N.11.25.C03.1.454.CMB.2.raw
  modified_base (343)..(343): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttgggccgccaggctccgaggggaagggctggagtcgggtctcctttattacngcagtggtagtacatactccgacagactccggtggacgggggccctaagttccaacccgtatcctaccgaaggaacgaaccaaacctactaaaaggaaacctacgtacttcgtttacttacaaaatacgaacacgaccctaggaacgacgcccgagtacgaaccgacgggccgttagtaacttacgtggtacgacggacgaggacggtccggggaccctaacgaaaccgttacgtaccgtacgtaagtacggggacgttaccggcgggggacccgaacggggaccctaccgg

SEQ ID NO: 423696 - DNA, 625 bp, Homo sapiens
  misc_feature: GZ8MTXP02GMZVV.11.25.C03.1.454.CMB.2.raw
  modified_base (318)..(318): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaaagccaggccagtcccctgtacttggtcatctaatcaagatgtgaagcggccctnagggactccctgagccgattctctggctccaactcgtagggaacgcacgccaactctcgaaaccctatcacggccggggaaccccagggtacctaagtggataggaacggtcgtagtaacttagtttagttagtacggtacgggtacggtacgggacgacgacgacgtactacgtacgtacccgtttaacgtcgttaccggttaacgggtaaacggtaacgggaaaccgtaaacgggtacccgtaaccggttaacgttacggtaacggtaccgaaccggaacccgaaaccggtaaccccaaaccccg

SEQ ID NO: 423697 - DNA, 597 bp, Homo sapiens
  misc_feature: GZ8MTXP02GFTVS.11.25.C03.1.454.CMB.2.raw
  modified_base (372)..(372): a, c, t, g, unknown or other
  modified_base (395)..(395): a, c, t, g, unknown or other
  modified_base (398)..(398): a, c, t, g, unknown or other
  modified_base (418)..(418): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatggtaggttcgggtccgccgaggcctccgaggggaagggctggaggtggtcttcctttattacagcagtggtatacatatccgnagctcgtggcggggccatccacntcncagacgacaactcaaagacncgtcttcgtttactaacaaatacgaacagcctagagacgccgatcgacgaccggtcgttagtacttcgtgtcgacgaggtacgacggtccggggacccaaacggtaaccgttacgtaccgtacgtaacggtcgggaaccggttcggtacgggggacccgtaaacggggacccgtaccgg

SEQ ID NO: 423698 - DNA, 608 bp, Homo sapiens
  misc_feature: GZ8MTXP02I8MLG.11.25.C03.1.454.CMB.2.raw
  modified_base (512)..(512): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgaggggaagggctggagtggtctctttattacagcagtggtagtacatattccgacagtactccgtggacgggggccgtaattccaacccattcctaccagaagacaaacctctaaaagaacacgcttgtttacctacaaaatgaaaccagccctaggagtaagcccgaattcggaaccacggggtacccgttgttaacttacgngtacggacgaaggagacgttcgggggacccaaacggtaacgttactaacgctaagtcgggaacgttcgacgggggaccaaagggggcccaaccggg

SEQ ID NO: 423699 - DNA, 744 bp, Homo sapiens
  misc_feature: GZ8MTXP02INPTM.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtgggaggaggcctgatccagccgtgggggtccctgagactctcctgtgcagcctctggttcaccgtcagtcacacctacatgaggttcgggtcccgccgacggccgtccggaagggggaacggggcgtggggaggttcggggttccttccctttttaatttaccgaggtcgtaaggttggttaaagtactatttacgttcccgacgaacgtaccgttcccgggttagggacggggggtccctaacgttcccaacccctacttcccgtaacccgaaaggaacgaacctaaaacccttactaaaacgaaaccctacgtcttttacgtttttaccttaacaaaaatcgaaaactacgtcccgttaggaacggacgacccgagtaccggaccgaccgggtccgttagttaacttacgtggtgaccggaaggacggtacgggtcccgggggaacccctaaacggtaaccgtttaacctacgtacgttaaggtacgggtaccggtacggtacgggggacccgaaacgggggacccctaccggg

SEQ ID NO: 423700 - DNA, 572 bp, Homo sapiens
  misc_feature: GZ8MTXP02GGOBJ.11.25.C03.1.454.CMB.2.raw
  modified_base (275)..(275): a, c, t, g, unknown or other
  modified_base (339)..(339): a, c, t, g, unknown or other
  modified_base (359)..(359): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtgggggtcctgagactctctgtgcagcctcgtggtcaccgtnagtcacacctacatgagttcggccgcaggctccgaggggaggctggagtggtctctttattacngcagtgtatacatactccgnagctcgtgcggggccatcaccatcacagacacaactactaaagaacacgtcttcgtttactacaaatacgaacagcctagaacgacgcccgaatcgaaccgacgggtccgttagtaacttacgtgtcgagtagagaggtccggggaacccaacggtaacgttacacgactaagtcggaacgtcggtacggggaccaacggggaccctaaccgg

SEQ ID NO: 423701 - DNA, 591 bp, Homo sapiens
  misc_feature: GZ8MTXP02HV8ZZ.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttcaccgtcagtcacacctacatgagttcgggtccgccgaggcctccgagggggaaggggcgtgggaggtgggtcttcctttatttacgagtcagtggtagtactatacttccgcagtacgtccggtgacgggggtccacttcaccgtatctccagacgacaactctaaagactacgcttgtttctacaaatcgaacacgcctgagacgaccgagtcgacgaccggtcgttagtacgttacgtggtcgcgaaggagacggtcgggccctaacgtaacgttacacgtctaagtcggacgtcggtcgggaccgaacgggacctaccgg

SEQ ID NO: 423702 - DNA, 536 bp, Homo sapiens
  misc_feature: GZ8MTXP02JHOHB.11.25.C03.1.454.CMB.2.raw
  modified_base (363)..(363): a, c, t, g, unknown or other
  modified_base (380)..(380): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccagtcccctgtatggtcatctatcaagatgtgaagcggccctcgagggactcccgtgacgccgattctctggctccaactcgtagggaacncacgccactctgacccntcacggccggacccaggctagtggatgagctagactattagtgcagggcgtaggacagcagcacgtcgcccgttatcgttcgttacggaacgtcgggaacctaacgggtccaaccgttcgttaggacgtcgacgacccgaacggacccaaaccccg

SEQ ID NO: 423703 - DNA, 608 bp, Homo sapiens
  misc_feature: GZ8MTXP02F6QIU.11.25.C03.1.454.CMB.2.raw
  modified_base (274)..(274): a, c, t, g, unknown or other
  modified_base (375)..(375): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtnagtcacacctacatgagttcggccgccaggcctaccgaggggaaggggctgggagtgggtcttccgtttattacagtcaggtgtaagtacattactccganacgactccggtggacgggggccattccacctatctaccagagacaactactaaagaccagtctcgtttactacaaatgaaactagcctgacgagccgatcgacgacgtccgtgttaacttacgtgtcgacggtagagacggtacgggggacccaaacggtaaccgttaaccgacggtacctaaggcggtaaccggttcggacgggggacccgaaacggggaccctaacccggg

SEQ ID NO: 423704 - DNA, 600 bp, Homo sapiens
  misc_feature: GZ8MTXP02JUK0R.11.25.C03.1.454.CMB.2.raw
  modified_base (339)..(339): a, c, t, g, unknown or other
  modified_base (502)..(502): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtgggggtccctgagactctcctgtgcagcctcgtggttcaccgtcagtcacacctacatgagtcggtccgcgtaggctccgaggggacgggctggaggtggtctctttattacngcagtgtatacatatccgacagactcggtggacggggccgattccaccatcctcgaagacaaccaaactcaaaaggacctagtcttacgtttactaactaaatacgaactagcccttagacggacgacccgatcgaaccgaccggggtcttaggttaacttgngtcgaggaggacgacggtccgggaaccctaacgtacgttacgacgtcgtaaggtcggtaccggtcgggaccggggaacccggaacgggtacccgacgg

SEQ ID NO: 423705 - DNA, 557 bp, Homo sapiens
  misc_feature: GZ8MTXP02F7JWT.11.25.C03.1.454.CMB.2.raw
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacacctacatgagttcgggccgccaggctccgaggggagggctggagtggtctctttattacagcagtgtatacatatccgcagactccgtggcggggccatcaccatctcagagacaaactcaaagacacgtctgtttactacaaatagaacagtcctagacgacgccgagtcgaaccgaccggtcgtagttaattacgtgtagcgtaggagacgcggggacccaaacgtacgttacacgataagtcggacgtcgcggggaccaacgggacctaccgg

SEQ ID NO: 423706 - DNA, 673 bp, Homo sapiens
  misc_feature: GZ8MTXP02GOPYS.11.25.C03.1.454.CMB.2.raw
  modified_base (559)..(559): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtctggaggaggcctgatccagccgtgggggtccctgagactctcctgtgcagcctcgtgggttcaccgtcagtcacacctacatggaggttcgggtccgccgaggcctaccgagggggaacggggctgggaggttcgggtccttcctttaatttacagtcaggtggtagtactattacgttccgacacgtaccgtccggtagggacgggggtcctattaccacctattccgtaccgaagaacgtaaaccaaaccttacgtaaaagaaccacgtactttcgttttactaacaaaatgtaaacacgcctaggaacgacgccgagtcgaacgaccggtcgttagtaaacgtttcgnggtgacggaagtacggacggtccgggggaccccaaaggttaaccgtttaacacggtactaacggtcgggtaccgttcgggtacgggggaccgtaaacggggacccctaaccggg

SEQ ID NO: 423707 - DNA, 586 bp, Homo sapiens
  misc_feature: GZ8MTXP02JGC3C.11.25.C03.1.454.CMB.2.raw
  modified_base (346)..(346): a, c, t, g, unknown or other
  modified_base (368)..(368): a, c, t, g, unknown or other
  modified_base (379)..(379): a, c, t, g, unknown or other
  modified_base (488)..(488): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggtctgatccagccgtggggggtccctgagactctcctgtgcagcctcgtgggttcaccgtcagtcacacctacatgagttgggtccgccaggctccgaggggaaggggctgggagtgggtctcctttattacngcagtggtagtacatattccgnagactccgtgngggggccattcaccatctaccagacgacaactactaaagacacgtcttcgtttcttacaaatacgaacagcctgacgagccgatcgacacggtccgtgttacttactgngcgaggagacgtcgggggaccctacggtaaccgttacgtaaccgtctaagtcggggtaaccgtcgggtacggggaccgaaacggggacctaacccggg

SEQ ID NO: 423708 - DNA, 686 bp, Homo sapiens
  misc_feature: GZ8MTXP02FQU9L.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtcgtgggtggagtctgggaggaggcctgatccagccgtgggggtccctgagactctcctgtgcagcctcgtgggtcaccgtcagtcacacctacatgaggttcgggtccgccgaggcctaccgaggggaaggggctagggagtgggtccttcctttattacagtcaggtgtagtacatacttccgcacgactccggtggcgggggcctacgttccaaccctattcctacccgaagaaacgaacctaaaactacgtaaaacgaaccgtaccgtactttacggttttacctaacaaaagtacgaaacacggtaccctaggacggacgaccggaagtaccggaacccgaccgggtaccgtttacgttaacgttaccgtaggtcggaacggaagacggtaacgggtccggggacccctaaacggtaaaccgttaccgaccgtacgtaacgtcgggtaccgtacgggtaccggggaccgaacgggggacctaacccggg

SEQ ID NO: 423709 - DNA, 607 bp, Homo sapiens
  misc_feature: GZ8MTXP02JAC1N.11.25.C03.1.454.CMB.2.raw
  modified_base (340)..(340): a, c, t, g, unknown or other
  modified_base (359)..(359): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttgggccgcaggctccgaggggaagggctggagtggtctctttattacngcagtggatacatatccgnacgactccggtgcgggggcctattccaccatctccagacacaactctaaagaacacgcttcgtttcttacaaattcgaacagcctagagacgccgatcgacgaccgggtccgttagttaattactggtgacggagaggacgtacgggggacccctaaacggtaaaccgtttaaccgtaacgggtacttaacggtcggggtaccgttaccgggacgggggaacccgtaaacggggaccccgtaaccggg

SEQ ID NO: 423710 - DNA, 656 bp, Homo sapiens
  misc_feature: GZ8MTXP02ILVXK.11.25.C03.1.454.CMB.2.raw
  modified_base (304)..(304): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttatttaaaaggagtccagtgtgaggtgcgtctggtggagtctgggaggaggcctgatccagccgtgggggtccctgagactctcctgtgcagcctcgtgggttccaccgtcagtcacacctacatggagttcgggcccnccgaggctccgaggggaaggggctgggaggttggtcttccttttatttacgagctaggtggtaagtacattacttcccgatacggaccttcccggtaggacggggggcctaactttcccaaccctacttcgtacccgaaagacgaacaaaccttacaaaacgaaccaacgtcttacgtttacttacgaaaatcgaacacgtcctagagacgccgagtcgaccgcggccgttgttaacttgtcgtagacgtaaggacggaacggtccgggggaccctaaacggtaccgttaacgtacgtacgtaacgtcgggaccgttcgggagggggtacccgaacggggaccgtaacccgg

SEQ ID NO: 423711 - DNA, 585 bp, Homo sapiens
  misc_feature: GZ8MTXP02FI0OA.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtcaccgtcagtcacactacatgagttgggtccgccaggcctccgaggggaggggctggagtgggtctctttattacagcagtgtagtacatatccgcagactccggtggacgggggccattcacccatctccagagactaaactctaaagaacacgtctgtttcttacaaatagaacagccctagagagcccgaagtcgaacgaccgggccgtaggttacttaccgtgtgacgaagaggaacgtcgggggaccccaacggtaaaccgttactaacgctaagtggaaccgtcgacgggggaccaaaacggggccaaccggg

SEQ ID NO: 423712 - DNA, 729 bp, Homo sapiens
  misc_feature: GZ8MTXP02GTOLX.11.25.C03.1.454.CMB.2.raw
  modified_base (614)..(614): a, c, t, g, unknown or other
  modified_base (673)..(673): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctcctgtgcagcctcgtgggttccaccgtcagtcacacctacatgtaggttcgggtcccgccgaggcctaccggagggggaaggggtcgtgggtaggttcgggttcctttaccttttatttacgagcgtaggtggtaagtactacttacgttccgacacgtaccgtccggtaggggacgggggcctaacttaccaacctacgttcctacccgaaagaaaccgtaaacctaaaacccgttacgtaaaaacgaacctacccgtacttttacgtttttactaaacgtaaaatcgaaaaccgtcgacccgttaggaacggaacgcccgtaagtacggaacccgtaccgggtaccgtttagttaaacttcgnggtacggacgaaggtacgacgggtccggggacccctaaacggtaccgtttaacacggtnttaaggtcgggaaccgttcggggacggggtaacccgaaacggggtaccctaaccgg

SEQ ID NO: 423713 - DNA, 611 bp, Homo sapiens
  misc_feature: GZ8MTXP02JDAE6.11.25.C03.1.454.CMB.2.raw
  modified_base (326)..(326): a, c, t, g, unknown or other
  modified_base (361)..(361): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtatggtcatctatcaagatgtgaagcgggccctgagggatccccngacgccgattctctggctccaactcgtagggaacncacgccactctacgaccatcgacgccgggacccagggacctagtggactgggaggtcctaggtaaccttagtttagttacgtccgaaggggtccgtaggggaccaggccaagccaacgtcggtaccccgtttagtcggttaccttacggggaaaccgttacggggaaccctaaaacggggttccctaaaccggttcgtttacggaacgttccgaaccggtaccccgaaacggaccccctaaaacccccgg

SEQ ID NO: 423714 - DNA, 579 bp, Homo sapiens
  misc_feature: GZ8MTXP02GQFXT.11.25.C03.1.454.CMB.2.raw
  modified_base (516)..(516): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtctgggaggaggcctgatccagccgtgggggtccctgagactctcctgtgcagcctcgtgggtcaccgtcagtcacacctacatgagttcgggtccgccgaggcctccgaggggaaggggctggaggtcggggtcttcctttatttacgagcaggtggtagtacattactccgcagacctccggtggacgggggtccagttccacctatcctaccagacgaacaactactaaagaaccacgtcttgtttactacaaatcgaacacgcctagagacgccgatcgaccacggctagtacttagtgtgacgagagngtcgggaccacggtaactacacgctaagtcggacgtcggacgggaccgaacgggacctaccgg

SEQ ID NO: 423715 - DNA, 715 bp, Homo sapiens
  misc_feature: GZ8MTXP02I9D63.11.25.C03.1.454.CMB.2.raw
  modified_base (256)..(256): a, c, t, g, unknown or other
  modified_base (373)..(373): a, c, t, g, unknown or other
  modified_base (467)..(467): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcngcctcgtgggttccaccgtcagtcacacctacatgagttcggtccgccgaggctccgaggggagggcgtgggagtggtccttctttattacagcgtagtggtagtactatactccgnacgtactccggtggcgggggcctactccacctatcctaccgagaacgacaacctactaaagacccagtcttcgtttactaacaaatcgaaaccngaccgtaggaaacggtcgacccgtaggtaccgaaccggtacccggggtacgtttacggttaactttacggtacggtcgggaccggtaaagggtacggggtaacggggtaccccggggggtaaaccccctaaaccggggttaaaaccgtttaacccgtaaccggttaccggttaacggttacggggtacccggggttacggggtccgggggaaacccggtaaaccgggggaaccccggttaaccccggg

SEQ ID NO: 423716 - DNA, 706 bp, Homo sapiens
  misc_feature: GZ8MTXP02JT1SA.11.25.C03.1.454.CMB.2.raw
  modified_base (327)..(327): a, c, t, g, unknown or other
  modified_base (376)..(376): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgatccagccgtggggggtccctgacgactctcctgtgcagcctcgtgggttccaccgtcagtcacacctacatgagttcggccgcaggctaccgaggggagggcngggagtgggtcttccgtttattacagcagtggtagtacactatcccganaggtacctccggtgggacgggggtccattccaccctatccctaccaaggacgaaaccctaaacgtactaaaacggaaacctacgtctttacgtttaccttaacaaaattcggaaaacctacggcccttaggaacgaccgacccggtattaccggaacccgtaccgggggtaccgttaggttaactttaacgtggtcggacggtaaggacgggacggttaccgggggacccctaaaccgggtaaacgtttaaacccgtaccggactttaaggacgggggtaccgtcggggttaccgggggaaccaaaacgggggtaccctaacccccgggg

SEQ ID NO: 423717 - DNA, 632 bp, Homo sapiens
  misc_feature: GZ8MTXP02H7QYF.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcatgatccagcctgggggtccctgagactctcctgtgcagcctctgggttcaccgtcagtcacacctacatgagttgggtccgccgaggcctccgagggaggggctggagtgggtctccgtttatttacagcagtggtagtaccagtacttccgacagaccgtccgtggacgggggccagttccaccatctcccagagacaactctaaagaacacgtcttgtttctactaaatcgaaacagccctaggaagacgccgatcgaaccgacggtccgtagttacttaacgtgttcggacgaggaacggacggttcgggggaccccctaaacgggtaaaacccgtttaaccgtaaccggtcgttaacgtaccggggtaccggttaccggtcggggggaaccctaaaacggggggtaacccccg

SEQ ID NO: 423718 - DNA, 796 bp, Homo sapiens
  misc_feature: GZ8MTXP02GQTH7.11.25.C03.1.454.CMB.2.raw
  modified_base (263)..(263): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtgggaggaggcctgactccagccggtggggggtccctgacgactctcctgtgcngcctcgtggttcaccgtcagtcacacctacatggtaggttcgggtccgccgaggcctaccggagggggaacggggcgtggggtaggttcgggttccttaccgtttttaatttacgaggtcgtaaggttagggtaagtacaacttacgttcccgacacggtaccgttccggggtagggaccgggggtccctaacttacccacctattcctacccgaaggaaacgaaacctaaaccttactaaaacgaacctaccgttctttacgttttactaaacaaaagtcgaaaacctcggtacctagggacgacggacccgtaagtacggaacccgtacgggtccgttagtttaacgttacgtgggtacggacggtaaaggacgggtacgggttacccgggggaacccccgtaaaacggtttaaaaccggggtttaaccctaccggttaaccgttaagggttaccgggggtaacccggtttacccgggggtaccggggggaaaaccccgtaaacgggggtaacccccgtttaacccggggg

SEQ ID NO: 423719 - DNA, 603 bp, Homo sapiens
  misc_feature: GZ8MTXP02J2W2G.11.25.C03.1.454.CMB.2.raw
  modified_base (298)..(298): a, c, t, g, unknown or other
  modified_base (341)..(341): a, c, t, g, unknown or other
  modified_base (364)..(364): a, c, t, g, unknown or other
  modified_base (374)..(374): a, c, t, g, unknown or other
  modified_base (419)..(419): a, c, t, g, unknown or other
  modified_base (444)..(444): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctggagactctcctgtgcagcctcgtgggttcaccgtcagtcacactacatgagttggccncaggctccgaggggaggctggagtgggtcttccgtttattacngcaggtggtatacatacttccgnagactccggngcgggctatcactatcacagactacaactctaaagactcgtcttnttacttactaatacgaacgacgcgngacgacgacgacgacgacgaccgtacgtacgttacgttacgtagtcggacggacggacggacggaccggggacccggtaaccggtaaccgtaaccgtaaccgtacgtaacggtacggtacggtaccggtacggggaccggtaaccgggaccggtaccgg

SEQ ID NO: 423720 - DNA, 585 bp, Homo sapiens
  misc_feature: GZ8MTXP02GODDZ.11.25.C03.1.454.CMB.2.raw
  modified_base (265)..(265): a, c, t, g, unknown or other
  modified_base (300)..(300): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttgtatcaacagaanccaggccagtcccctgtattggtcatctatcaagntgtgaagccgcctgaggactcctgagccgattcctactcggctcccaacgtcgtacgggaaacgcacgccactctcgaccatccgacgccggacccaggctagtggactggacgtctagtacttattagttcgacgtagggccgtagggacaggacgacgcacgtcgtacccgtttagtcggttccgtacgggtaaaccgtcggggaaccgtaaacggggtcctaacccggttaacgttcggaacggttaccaccggaccccgaaacggaccccctaaacccccg

SEQ ID NO: 423721 - DNA, 687 bp, Homo sapiens
  misc_feature: GZ8MTXP02I28DF.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtgggaggaggcctgatccagccgtgggggtccctgagactctcctgtgcagcctcgtggtcaccgtcagtcacacctacatgaggttcggccgccgaggctccggaagggggaaggggcgtggaggttcgggttccttacctttaagtttacagtctaggttcggtaacgtaactacttacgttccgtacgacgtacgtccggtacgggcgggggtccgacttacgaccacgtcctaccgagaaacgactaaacctctaaaacgaaacgtaccgtactttcgtttaacttacaaaacgtacgaactaagccgttagaacgcgtaccacgtaggacccgacggtcccgttagtaactttcggtgtcggacgtaaggagtacggtaccgggggtaccctaaacggtacccggttaaacgttcgaacgtaaggtacggtacggtaccggtcggggaacccggtaacggtacccggtacccgg

SEQ ID NO: 423722 - DNA, 657 bp, Homo sapiens
  misc_feature: GZ8MTXP02IZ8OB.11.25.C03.1.454.CMB.2.raw
  modified_base (329)..(329): a, c, t, g, unknown or other
  modified_base (372)..(372): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttggtatcaacagaagccaggccacgtcccctgtatggtcatctatcaagatgtagaagccggcctcgagggctcccgngacgccgtattcctctcggcctaccaactcggtcgggaaaccnccaacgccaactcgtcgaaccctacgtaccgacggcccgggaaacccaggggtacccttaaggtcgggtaacgtggagggccttaaggtaaccttaattttaagttggtaccgtaagggggtcggttacggggaccaaggccgaaacggccgtaaccgttcggtaccccgtttaagttcggttcccgttacggtaaaccggttaccgggaaccgtaaacggtccgtaaccggttccgttaggaccgttaccaaccgacccccgaacgggaccccctaaaaccccg

SEQ ID NO: 423723 - DNA, 535 bp, Homo sapiens
  misc_feature: GZ8MTXP02FE91E.11.25.C03.1.454.CMB.2.raw
  modified_base (362)..(362): a, c, t, g, unknown or other
  modified_base (416)..(416): a, c, t, g, unknown or other
  modified_base (443)..(443): a, c, t, g, unknown or other
  modified_base (466)..(466): a, c, t, g, unknown or other
  modified_base (475)..(475): a, c, t, g, unknown or other
  modified_base (515)..(515): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctagtggagtctggaggaggcctgatccagcctggggggtccctgagactctcctgtgcagcctctgggtcaccgtcagtcacacctacatgagttgggtccgccaggctccaggggaaggggctggagtgggtctcctttattacagcagtggtagtacatattccgnagactccgtgaggggccattcaccatctccagagacaaactcaaagaacagtcngttttctacaaatgaaacagcctgagngccgatgacacgggctgtatacngtgcgagangtcggggcccaacgaacgttacacgctaagtggaactcgnggggaccaacgggtccacgg

SEQ ID NO: 423724 - DNA, 654 bp, Homo sapiens
  misc_feature: GZ8MTXP02GU7K0.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccaggccgtggggggtccctgagactctcctgtgcagcctcgtggttcaccgtcagtcacacctacatggtagttcgggtccgccaggcctccgaggggaaggggcgtgggtaggtgggtccttcctttatttacgagtcgtaaggttggtaagtacaacttacgttcccgacacgtaccgtccggttgggccgggggccgtaacttccgaaccactctacccgaagaacgacctaaactcgtaaaagacacgtcttagtttctaacaaaatcgaaactacgcctaggacgacgacgagtacgaccgaccgggtccgtagttaacttacgtggtacggacgaaggtacgtacgggtacggggacccctaacgtaaccgttacgtacgacgtaagtcggacggtcggtacgggacgtaacggggacctaccgg

SEQ ID NO: 423725 - DNA, 598 bp, Homo sapiens
  misc_feature: GZ8MTXP02I7EAD.11.25.C03.1.454.CMB.2.raw
  modified_base (299)..(299): a, c, t, g, unknown or other
  modified_base (370)..(370): a, c, t, g, unknown or other
  modified_base (380)..(380): a, c, t, g, unknown or other
  modified_base (409)..(409): a, c, t, g, unknown or other
  modified_base (420)..(420): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtggggggtccctgagactctcctgtgcagcctcgtgggtcaccgtcagtcacacctacatgagttgggtccnccaggctccgaggggaagggctgggagttgggtcttcctttatttacagcgagtggtagtacatactccgnagctccgtgngggggccatcaccatctcagacactaacnctaaacgaacncgtcttcgtttactacaaatagaaacagtcctagaggacgaccgatacggaacaccgggtcgttagttaattacgtggtcgacgacggaggacggtccgggggaccctaacggtaaccgttacacggtacttaagtcgggtacgtcggacgggggaccgaaacggggacctaaccggg

SEQ ID NO: 423726 - DNA, 570 bp, Homo sapiens
  misc_feature: GZ8MTXP02F8HN7.11.25.C03.1.454.CMB.2.raw
  modified_base (362)..(362): a, c, t, g, unknown or other
  modified_base (374)..(374): a, c, t, g, unknown or other
  modified_base (415)..(415): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggttcaccgtcagtcacacctacatgagttggtccgccaggctccgagggaaggggctgggagtgggtctctttattacagcagtggtagtacatattccgnagactccgtggnggggccattccaccatctccagagacaactactaaagaacncgctgtttctacaaatcgaacagcctgacgacgccgatgaaccgcggtaccgtgttaattcgtggtcgcgaagagacgtacgggggacccaacggtaaaccgttacacgtctaagtggaccgtcggtacgggggacctaacggggaccctaacgg

SEQ ID NO: 423727 - DNA, 806 bp, Homo sapiens
  misc_feature: GZ8MTXP02H9SJK.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtcgtgggaggaggcctgatccagccgtgggggtccctgagactctcctgtgcagcctcgtcgggttccaccgtcagtcacacctacagtgaggttcgggtcccgccgacggcctaccggagggggaaggggcgtggggaggtcgggttcttccttttatttacgagtcgtaggttggtaagtactattacgttcccgactacggaccgttcccgggtagggaccggggggtccctaacgtttacccaaaccccgtacttacccgtacccgaaacggaaacgaaacctaaacccgttaaccgtaaaacggaaaaccctaacccgggttaccttttacggtttttacctttaaaccgtaaaaacgttacggaaaaccgtaaccggtccccgttagggaaacggaaccgggtacccggtaagttaccggaaacccggtaccggggttacccggtttaggtttaaactttacggttacggtacgggtaccggaagggaacggtacgggtaccgggggaaacccccgtaaacggttaaaccgttaaccgtacggtacgtaaggtacggtacggtcggacggggtaccgaacggggaccgtacccgg

SEQ ID NO: 423728 - DNA, 691 bp, Homo sapiens
  misc_feature: GZ8MTXP02IV7WL.11.25.C03.1.454.CMB.2.raw
  modified_base (590)..(590): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagtcttgggttttccttgttgcttaattttaaaaggagtccagtgtgaggtgcgtcgtggtggagtcgtgggaggaggcctgactccagccggtcggggggtccctgacgtactctccgtgtgcacgcctcgttcggttcccaccggtcacgtccacctacctacagtggaggttcgggtcccgccgacggccgtaccggaagggggaagggcgtagggaggttcggttccttccttttaagttaccgagctaggtagtagtactaacttacgtccgacacgtccgtcccggtagggcgggggaccctattacccacccgtatccgtaccagaacgaacctaaactactaaagaacctagtctttcgttaactacaaaacgtcaaacacgtaccgtaggaagaccgtaccgaggttaccgaaccgccggtacgtagttacttacgngtacgacgaggagtaccggtaccgggaccctaacggtaacgtacctacgtacgtaacgtacggacggttcggacggggaacccaacggggtacccgaccgg

SEQ ID NO: 423729 - DNA, 721 bp, Homo sapiens
  misc_feature: GZ8MTXP02GN4OW.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctaattttaaaaggagtccagtgtgaggtgcgtcgtggtggagtcgtggaggaggcctgatccagccgtgggggtcctgagactctcctgtcgcagcctcgtgggttccaccgtcagtcacacctacatgtaggtcggtccgcgaggcctccggaggggacgggcgtgggtaggtcgggtccttacctttaatttacgagtcgtaggtaggtaagttaactacttaacgttccgacacggtaccgtccgggtgggacggggggtcctaaacgttccaaacccgtatacccgtaccaaaggaaacgtaaacctaaacgttaaccgtaaaacgaaaccgtacccgttacgttcgttttaaccttaacgtaaaatacgaaaccgacggtccgtaaggaacggtacggacccgtaagtacgaaacccgtaaccggtcgttaacgttaacttaccgtggtacgacgggaacgaggtaaccggtcggggaacccctaaacggtaacgttacgtaacgcgtaacgtcggaccggtcggacgggaccgaaacggccgtaacccgg

SEQ ID NO: 423730 - DNA, 688 bp, Homo sapiens
  misc_feature: GZ8MTXP02JQXSP.11.25.C03.1.454.CMB.2.raw
  modified_base (375)..(375): a, c, t, g, unknown or other
  modified_base (498)..(498): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtcgtgggaggaggcctgactccagccgtcggggggtccctgacgactctctgtgcagcctgtggttcaccgtcagtcacacctacatgaggtcggtccgccaggctcgaggggagggctggagtcggtcttcctttattacgagtcaggtgtagtactatacgttccganacgcgttccggtgggacgggggccgtacttccaacccgtatcccgtaccgaagaacgaaccctaaactaccgtaaaacgaccctaacggtcttttcggtttacctaacaaagttcgaaaaccncggtacctaggacggacgacccgaagtacggaaccgacgggtaccgtttataaccgtttacgttggaggaccggaaggtacggaacggtccgggggaaacccccaaaggttaaacccgttaaccgtaacgtccgtaaggtacggaccccggttggtacgggggaacccgtaaacggggacccgtacccgg

SEQ ID NO: 423731 - DNA, 712 bp, Homo sapiens
  misc_feature: GZ8MTXP02FIGYQ.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggtccaccgtcagtcaccacctacatgagttcggccgccaggcctaccggaggggaaggggcgtgggtaggtcgggttccttcctttaatttacaggtcaggttaggtacgtaacacttacttcccgacacggtacctcccggtagggacgggggccctaagtttccaccctactctacccgaaggaaacgaacccaaaccttacgtaaaacgaaaccgacccgtacctttcgttttaccttaactaaaatacgaaacacgtcccgtaggaacggacgcccgtaagtcgaacccgtaccggtcccgttagttaacttacgtggtacgacggaaggtacggacggttccgggggaaacccctaaacggaaacccgtttacgaaccgtaccgttaaggtcggggaaccggttcggaccgggggaccgaaaaccggggtacccgtacccggg

SEQ ID NO: 423732 - DNA, 637 bp, Homo sapiens
  misc_feature: GZ8MTXP02J29JP.11.25.C03.1.454.CMB.2.raw
  modified_base (524)..(524): a, c, t, g, unknown or other
  modified_base (532)..(532): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcgtgggttttcctgttgctatttaaaaggagtcagtgtgaggtgcgtctggtggagtctgggaggaggcctgatccagccgtggggggtccctgagactctcctgtgcagtccttcgtgggttcacccggtcagtcactacctacatggagtttcggccgcaggcctccggaggggagggctgggagttggtcttcctttattacagcaggtggtatacgatacgtcgacaacgtctccggttggccgggggtccaattccactattaccaccagacgaaacaactacgtaaacgacgacgtctttagttacctttaacgaaattcgaaaacgcgtaccgagacgcggtacccagtacgaccgtaccggtcgtagttntacgtggngacgaggagcggacggggtacccaacggttaacgtaccgtacggtaacgtcgttcggggacgttaccggggtacggggaccgtaaaaccggggcctaacccgggg

SEQ ID NO: 423733 - DNA, 671 bp, Homo sapiens
  misc_feature: GZ8MTXP02H86Z4.11.25.C03.1.454.CMB.2.raw
  modified_base (180)..(180): a, c, t, g, unknown or other
  modified_base (301)..(301): a, c, t, g, unknown or other
  modified_base (342)..(342): a, c, t, g, unknown or other
  modified_base (362)..(362): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggngtccagtgtgaggtgcgtcgtggtggagtcgtggaggaggcctgatccgagccggtgggggtcctgacgactctctgtgcacgcctgtggtcacgtcacgtcacactacatgagtcggccncgaggctcggaggggaggcgtggagtggtcttctttatacngcagtgtatacatactcganagacgtcggtggacgggtctatccactactctaccgagaaacaaccaaacttacgaaaacgaacctcgttacttttagtttaccctaaacgtaaaaagtcgaaaacctacggtacctaaagggaacgtaaccggtaccgaagtaccggaaaccggtacccgggtacctttaggtttaaaactttcgaggtacggaacgtaggaacggtacggacccggggaaacccctaaacggtaaaccgttacccgtaagacgttaaggtcgggacgttcgggaaccggggaccgtaaaccgggggaccctaccggg

SEQ ID NO: 423734 - DNA, 719 bp, Homo sapiens
  misc_feature: GZ8MTXP02GIG0K.11.25.C03.1.454.CMB.2.raw
  modified_base (384)..(384): a, c, t, g, unknown or other
  modified_base (395)..(395): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtggggggtccctgagactctctgtgcagcctgtgggtcaccgtcagtcacacctacatggacgttggtccgccgaggactccagtgggaaggggctgggaggttcgggtccttaccttttatttacgagtcgagtggtatacccattacttccgacncgacttccggngggtacgggggcctagttccaacctatcctaccgaggaacaacccaactactaaacggaaacctacgtcctttagtttaccttaacaaaacgttcgaaaaccgtacggcccttaggaacgaccgggacccgtaagtaccggaccgaacggggtcccgttaaggttaacctttacgtgggtacgacgggtaagacgggtacggttaccgggggacccctaaaacggggtaacccgtttaacggtaacccgtaacggtttaacggtcgggggtaacccggtttcggggtaaccgggggtacccccggaaaagggggtaaccccccg

SEQ ID NO: 423735 - DNA, 633 bp, Homo sapiens
  misc_feature: GZ8MTXP02FJPM3.11.25.C03.1.454.CMB.2.raw
  modified_base (236)..(236): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctaggaattgaattganagataaatatacttgttagtatacaacagaagccaggccacgtcccctagtacttggttatctatcaagtatgtagaacgccggaccctcgagggtactcccgtagacgtcgtacttcctacgtcggacctacccgtaaacgttcggtacgggaaaccgcacgtacccaacttcgacgaaccctaactaccgacggacccggggaacccaggaccgtagtagggataggacggtacgtagtaaagttatttaaggtggtaccggagggtaccgggtagggaccaggacgaggtcctacgtcgtacccgttagtcgttaccgttacggaacgtaggaacccgtaacggtcctaacggttctaagacgtaccaccggacccgtaacgaccccacctacg

SEQ ID NO: 423736 - DNA, 585 bp, Homo sapiens
  misc_feature: GZ8MTXP02HYUFG.11.25.C03.1.454.CMB.2.raw
  modified_base (354)..(354): a, c, t, g, unknown or other
  modified_base (364)..(364): a, c, t, g, unknown or other
  modified_base (373)..(373): a, c, t, g, unknown or other
  modified_base (415)..(415): a, c, t, g, unknown or other
  modified_base (430)..(430): a, c, t, g, unknown or other
  modified_base (440)..(440): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtggggggtccctgagactctcctgtgcagcctcgtggggttccaccgtcagtcacactacatgagtggccgcaggctccgaggggagggctggagtggtcttctttattacagcagtggtagtanactattccgnagactccgngcggggcctattccaccatcaccagacacaactctaagaacncgtcttgtttctaanaaatgaaacngcctaggacgacgcccgagtacgaaccgaccgggtccgttagttacttaaccgtggtacgacggtagacggtaggtccgggaccccaagtaaaccgtcgtaacgctaagtcgggacttcggaggggacccaaggggtacccacgg

SEQ ID NO: 423737 - DNA, 578 bp, Homo sapiens
  misc_feature: GZ8MTXP02HYDY7.11.25.C03.1.454.CMB.2.raw
  modified_base (365)..(365): a, c, t, g, unknown or other
  modified_base (537)..(537): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtctggtggagtctgggaggaggcctgatccagccgtgggggtccctgagactctcctgtgcagcctcgtgggttcaccgtcagtcacacctacatgagttcgggccgccaggcctccgaggggagggctggagtggtctctttattacagcagtggtagtacatattccgnagctccggtgacgggggtccattccaccatcctccagacgacaactctaaagaccacgcttgtttctacaaatcgaacagcctagagacgccgatgaccgacggcttagttacttacgtgtagtaggaacggagtacggtcggggacccctaaacggtaaccgttactacgntaagtcggacgtcgtacggggacctaacgggaccctaccgg

SEQ ID NO: 423738 - DNA, 829 bp, Homo sapiens
  misc_feature: GZ8MTXP02G0U2R.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtctggaggaggcctgatccagccgtgggggtccctgagactctcctgtgcagcctcgtggttcaccgtcagtcacacctacagtgagttcgggtcccgccaggccgtacccgagggggaacggggcgtagggaggttcggggttccttaccctttttaagtttaccgaggtccgtaagggttggtaaacgttaacctaagtttaacgtttcccggacaacggtaccgttcccgggttagggacggggggtccctaagtttcccgaaccctaacttccgttaacccgaaagggtaaaccgaaacctaaaaccctttacgtaaaaacggaaacctaacccggttcctttacggtttttacttaaaacccgtaaaaattacgggaaaaccctaacggtaccccgttaagggaaaccggtaaccggaacccggtaagttaaccggaaacccgttacccggggtacccgtttaagttaaacgtttaaccgtttggggacccggaacggtaaaggaaaacgggtcggttacccgggggacccctaaacggtaaccgttaaccgtaccggtacgtaagtacgggaaccggttcggaccgggggaaccgtaaacggggaacccgtaacccggg

SEQ ID NO: 423739 - DNA, 576 bp, Homo sapiens
  misc_feature: GZ8MTXP02I28YP.11.25.C03.1.454.CMB.2.raw
  modified_base (342)..(342): a, c, t, g, unknown or other
  modified_base (372)..(372): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctgggttcaccgtcagtcacacctacatgagttcggccgccaggctccgaggggagggctggagtggtctctttattacagnagtggtagtacatactcgcagactccgtgnggggccattccacatcaccagacgacaactactaaagaacacgtcttagtttactacaaatgaaactagcctagaacgacgaccagtacgaccgacggtccgtagtacttacgtgtcgagacgagtacgcgggacccaacggtaacgttaccacgtacgtaagtacggtacgtcggtaggggacctaaacggggacctaccggg

SEQ ID NO: 423740 - DNA, 749 bp, Homo sapiens
  misc_feature: GZ8MTXP02IM3A5.11.25.C03.1.454.CMB.2.raw
  modified_base (257)..(257): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgactccagccgtgggggtccctgagactctcctgtcgcncgcctcgtgggttcaccgtcagtcacacctacatgtagttcgggcccgccgaggcctccggaagggggaacggggcgtagggtaggttcgggtttccttacctttttagtttaaccgagtcgtaggttggtaacgtactaagttacgttcccgactacggtaccgttcccgggttagggaccggggggtcctaaacgtttcccacccgtaacttcctaccgaaggaaacgtaaacctaaaccgtaacgtaaaacgaacctaacgtctttacgttttacctaactaaaacgtcgaaaactacgtaccgtagaacggtacgacccgtaagtaccggaacgtacccggtaccggttattaacgttacgttggtacggacgaaggacggacggtaccggggaacccgtaaaccggttaaaccgtttaaccgacgcgtttaaacggcgggtaccggttacgggacggggaaacccggtaacgggtacccgtaaccgg

SEQ ID NO: 423741 - DNA, 601 bp, Homo sapiens
  misc_feature: GZ8MTXP02ISWY7.11.25.C03.1.454.CMB.2.raw
  modified_base (284)..(284): a, c, t, g, unknown or other
  modified_base (316)..(316): a, c, t, g, unknown or other
  modified_base (334)..(334): a, c, t, g, unknown or other
  modified_base (352)..(352): a, c, t, g, unknown or other
  modified_base (375)..(375): a, c, t, g, unknown or other
  modified_base (383)..(383): a, c, t, g, unknown or other
  modified_base (391)..(391): a, c, t, g, unknown or other
tcagcgagagataccacgaccggtgctcgatttagtagtgtagatttgggtttggggagagggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagcctggggggtccctgagactctcctgtgcagcctcgtgggttcaccgtcagtcacacctanatgagtcggccgcagctcgaggggaggctggngtggtctctttatacagnagtgtagtacatactcanagactcgtgcgggctatacacanactcaganacaactanaaacgaacacgtcttcgtttactacaaaatacgaaacagtccgtaggaagacgcccgaatacgaaccgtacggtccgttagtaacttacgtggtcgaacggtaacggaacgacggtccgggggaaccccaaacgggtaaaccgttaaacgtacgacgttaaggtcgggtaacgttcggacgggggaaaccgaaacggggaaccctaacgg

SEQ ID NO: 423742 - DNA, 670 bp, Homo sapiens
  misc_feature: GZ8MTXP02JN8GG.11.25.C03.1.454.CMB.2.raw
  modified_base (306)..(306): a, c, t, g, unknown or other
  modified_base (392)..(392): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgactccagccgtggggggtccctgagactatcctgtcgcagccctgtgggttcaccgtcagtcacacctacatgagttcgggtccnccgaggcctccgaggggaagggctgggagtggtcttctttattacagctagtggtagtacagtacttccgacacgaccgttccggngggacgggggccctacgtttaccaacccgtattacccgtacccgaaggaaacgaacctaaaaccttacgaaaacgaaaccgtacgtactttacgttttaccttaacaaaatcgaaaacacgtccgtaggacgacggacccgtagtacgaaccgacgggtaccgttagttactacgtgtacgacggaacggagtacggtcggggacccaacggtaaaccgttactacggactaaggtcggaacgttcgggacgggaccgaaaaccgggccgtaacccgg

SEQ ID NO: 423743 - DNA, 619 bp, Homo sapiens
  misc_feature: GZ8MTXP02HD7L6.11.25.C03.1.454.CMB.2.raw
  modified_base (489)..(489): a, c, t, g, unknown or other
  modified_base (519)..(519): a, c, t, g, unknown or other
  modified_base (529)..(529): a, c, t, g, unknown or other
  modified_base (564)..(564): a, c, t, g, unknown or other
tcagcgagagataccacgaccggtgctcgatttagtagtgtagatttggggtttgggggggagaggagcccagcactgggattccgaggtgtttccattcggtgatcagcactgaacacagaggactcaccatggagttttggctgagcttgggttttccttgttgcttattttaaaaggagtccagtgtgaggtgcgtctggtggagtcgtgggaggaggcctgatccagccgtggggggtccctgagactctcctgtgcagtcctcgtgggttcaccgtcacgtcaccacctacatgaggttcggccgcaggctccggaggggagggctgggagtggtccttctttatttacagcagttggtatactatacttccgcagtacctcggtagggcggggtccgtattccaccgtactcctaccgaaggacaactaaactacaaacgacacgtcttcgtttactaacaaagtacgaacagcctaggacgngaccgatacgacgacggtctagttactcgngtagcgtagngtacggcgggacccaacgttaacgtacgtaaccgngtaacggtacgggtacgtacggtacggggacccgaaacggggacccgtaacccgg

SEQ ID NO: 423744 - DNA, 809 bp, Homo sapiens
  misc_feature: GZ8MTXP02G6PZ0.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttattgcttaattttaaaaggagtccagtgtgaggtgcgtctggtggagtcgtgggaggaggcctgactccagccgtgggggtccctgagctctcctgtgcagcctcgtcggtcaccgtcagtcacacctacatggacgttcgggtccgccgaggctccggaagggggaacggggcgtggggaggtggggttccttcctttaatttacgacgtctaaggtaggtaagtaactacttacgttcccgacacggtaccgttccggtagggacgggggccctaacgtttacccaaccctacttccgtaccgaaacgaaacgtaaacctaaaacccttacaaaacggaaaccctaacggtaccgttttaccgtttactttaaaccaaaaaagttcgaaaacccgttaggaaccctgggaaacggacggtacccgtaagttaaccgaacccgtaaccggggtcccgttaagtttaacgtttacggtagtggaacgtaagggaacggtacgggtaccgggggaaacccctaaaaccgggttaaaaccggtttaaaccgtaacccggtacgtttaaacgggtacggggttaaaccgggtttacccggggtaaccggggggaaacccccgtaaaaacgggggaacccccgttaaacccgggg

SEQ ID NO: 423745 - DNA, 596 bp, Homo sapiens
  misc_feature: GZ8MTXP02G6WHW.11.25.C03.1.454.CMB.2.raw
  modified_base (341)..(341): a, c, t, g, unknown or other
  modified_base (362)..(362): a, c, t, g, unknown or other
  modified_base (374)..(374): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctcctgtgcagcctcgtgggttcaccgtcagtcaccactacatgagttggtccgccaggctccgaggggagggctggagtggtctctttattacngcagtgtagtatatattccgnagaccgtccggngggacgggggccctaagttcaaccctatcctaccaagacgaaccaaactactaaagaaccacgtacttcgtttacttacaaaatgaaacacgcctagacgacgaccagtacgacgacggtccgtagtactacgtgtgcgagagacgtcggggacccaacgtaacgttaccacgtactaagtcgggaacgttcggacggggacccgaaaggggaccctaacgg

SEQ ID NO: 423746 - DNA, 649 bp, Homo sapiens
  misc_feature: GZ8MTXP02GH1MQ.11.25.C03.1.454.CMB.2.raw
  modified_base (277)..(277): a, c, t, g, unknown or other
  modified_base (303)..(303): a, c, t, g, unknown or other
  modified_base (394)..(394): a, c, t, g, unknown or other
  modified_base (450)..(450): a, c, t, g, unknown or other
  modified_base (477)..(477): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccaggccgtggggggtccctgagactctcctgtgcagcctcgtgggttcaccgtnagtcacacctacatgagttcggtccnccgaggctccgaggggagggcgtgggtaggtgggtcttaccttttattacgagtctaggtggtagtacactactccgcacgtacctccggngggacgggggcccgtattccaccatcctaccagaacgacaaactactaaagaaccncgtcttgtttactacaaaatcgaaacncgtactagacgacgacgtagtacgacgaccggtcgttagttacttacgtggtcggacgaaggtacggtacgggtccggggaacccctaaacgggttaaccgttaccgtaacgtcgtaacggtacgggaccggttcggggaccggggaccggtaaacgggggacccctacggg

SEQ ID NO: 423747 - DNA, 599 bp, Homo sapiens
  misc_feature: GZ8MTXP02H33BC.11.25.C03.1.454.CMB.2.raw
  modified_base (258)..(258): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagactcccctgctctggaattgaattgagagataaatatacttgtgtatcaanagaagccaggccacgtcccctgttagttggtcatctatacaagagtgtaggacgccggccctcgacgggtactcccgtggacgtacccgtattccgtcgtcggcctacccgtaacgttcgtagggaaccgccgacgccctacgtctacgacctatccgacggacccgggacccaggtactagtcggatggagctagtaacttattaacgttgtacgtagggtcgtagggacacgcgacgctacgtcgtcccgtttagtcgttacggttacggaacgtacgggaccgaacggttcctacggttcgttaggacgtacgacgacccgtaacgacccctaacccg

SEQ ID NO: 423748 - DNA, 591 bp, Homo sapiens
  misc_feature: GZ8MTXP02HW1N6.11.25.C03.1.454.CMB.2.raw
  modified_base (277)..(277): a, c, t, g, unknown or other
  modified_base (384)..(384): a, c, t, g, unknown or other
  modified_base (468)..(468): a, c, t, g, unknown or other
  modified_base (483)..(483): a, c, t, g, unknown or other
  modified_base (506)..(506): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgactccagccgtggggggtccctgagacctctcctgtgcagcctcgtgggtcaccgtnatcacacctacatgagtcggtccgcaggctccgaggggagggctggagtggtcttccgtttattacagcaggtgtagtacattacttcccgctacgaccgttccggngggccgggggtcaacttcaccctatctaccaggacaacctaactacgtaaagaccagtcttacgtttctaacaaatacgaaacncgcagacgacgcganacgacgcgtacgtagtacttcgngtgacgaggacggacggccgggacctaaacgtacgttacacgagtaacggtcggacggtcgggacgggaccggaacggtaccacg

SEQ ID NO: 423749 - DNA, 656 bp, Homo sapiens
  misc_feature: GZ8MTXP02FUZX1.11.25.C03.1.454.CMB.2.raw
  modified_base (271)..(271): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtggttcaccgtnagtcacacctacagtgagttcggtccgccgaggcctccgaggggaaggggctggaggtcgggtcttcctttattacagctagtggtatacatcttccgacagtaccgtcggtacggcgggggccctagttccaaccgtctacctacccgaagaacgaacaaacctacgtaaacgaactacgtcttcgtttactacaaagtacgaactagtcctagagacgcccgaatacgaccgacgggtccttagttacttacgtgtacggcgaaggtaggacggtaccgggggaccctaaccggtaaaaccgtttaccgtaccggtaactaacgggttacgggaaccggtttcgggacgggggaaccgaaaacgggggacccctaacccgggg

SEQ ID NO: 423750 - DNA, 661 bp, Homo sapiens
  misc_feature: GZ8MTXP02IYC8H.11.25.C03.1.454.CMB.2.raw
  modified_base (256)..(256): a, c, t, g, unknown or other
  modified_base (298)..(298): a, c, t, g, unknown or other
  modified_base (346)..(346): a, c, t, g, unknown or other
  modified_base (367)..(367): a, c, t, g, unknown or other
  modified_base (401)..(401): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctgggaggaggcctgatccagccgtggggggtccctgagactctcctgtgcngcctcgtggtcaccgtcagtcacacctacatgagttcggccnccgaggcctccgaggggagggctggaggtggtcttcctttatttacgngcgtagtgtatacatctccgntacgactccggtggcgggggtcctattccacctntctaccgagaacgaaccaaacttacgtaaaacgaaccacgttacctttcggtttacttacgaaaaagtcgtaaacaacggtccccgttaggaacgaccgacccgtaaagtcccggaacccgaacgggttccgttagttaaaccgttgtaggtcgaacggtaagaggaacggtccgggggaaaccctaacgtaaaccgttactaacgacgtaagtaccgggaacgttccgggacggggacccgaaacgggacccgtaccgg

SEQ ID NO: 423751 - DNA, 713 bp, Homo sapiens
  misc_feature: GZ8MTXP02GV9R9.11.25.C03.1.454.CMB.2.raw
  modified_base (359)..(359): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtcgcagcctcgtgggttcaccgtcagtcacacctacatgaggttcgggtcccgccgacggctaccgagggggaacggggctgggaggtgggtcttcctttatttacngtcgtaggttggtaagtactattacgttccgacgtaacggtaccgttcccgggttagggaccggggggtccctaacgttacccaacccttacgtttcccgaaaccgaacggtaaaccaaaccgtaaactaacgtaaaaacgaaccgtaacgttcgtttaacgtttactaaaacgtaaacgtaacgaacgtacgtacgtaagacggtacgacgtacggacgaccgtacccggtgttacgttaacgtcgtagtcgagtaacggagtaccgggccggaaaccgtaacgttaaccgtaccgtacgtacgtaaggtacggtcggtacgggtaccggaaccggaccggtaccgtacccgg

SEQ ID NO: 423752 - DNA, 802 bp, Homo sapiens
  misc_feature: GZ8MTXP02H6WUE.11.25.C03.1.454.CMB.2.raw
  modified_base (312)..(312): a, c, t, g, unknown or other
  modified_base (551)..(551): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtctgggaggaggcctgatccagccgtggggggtccctgagactctcctgtgcagcctcgtgggttccaccgtcagtcaaccacctacatggaggttcgggcccncgaggctaccggaagggggtaacgggcgtgggacggttgggttaccttccgtttttaattacgagcgtaaggttaggtactactaactactccgacgacgtacgttccggtagggacgggggtcctaattccgaacctactcccgtaccgaaggtaaaccgtaaaccaaaccttaacgaaaacgtaacccgtaacggttccctttaggtttaaccttaacaaaaagttccgaaaaaccncggtaccgtaaggaacgtaacggtacccgtaaggtaccgtaaccggtacccggggttaccgtttaaggttaaccgttcggtacgggtacggaaacggaacggggtaacggtaacccgggtacccgggggtaaaaccccgtaaaccggttaaaccgttaaaccgtaccggtaacggttaacgggtaccggggtaaccgggtacccggggaaccgggggtaaacccggtaaaccgggtaaccccggtacccgg

SEQ ID NO: 423753 - DNA, 625 bp, Homo sapiens
  misc_feature: GZ8MTXP02I0AQK.11.25.C03.1.454.CMB.2.raw
  modified_base (258)..(258): a, c, t, g, unknown or other
  modified_base (354)..(354): a, c, t, g, unknown or other
  modified_base (497)..(497): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtctgggaggaggcctgactccagccgtgggggtccctgagactctctgtgcngcctctgggttcaccgtcagtcacacctacatggagtttcgggccgccaggcctaccggaggggaaggctgggagttgggtccttctttatttacngtctagtgtacgtacattactccgactagtactcccggtaggcggggcctattccacctactctccaagacgaactaaactactaaagactacgtcttgtttacaactaaaatacgaacaacgtccgtagacgtacgccgtancgaccgaccggtcgttatacttagtcgtgaacgacggagtacggccggggtaacccaaacggttacccgtaactaccgtatcggtacggtcggttacggcggggaacccgacggggaacccgtaccgg

SEQ ID NO: 423754 - DNA, 588 bp, Homo sapiens
  misc_feature: GZ8MTXP02J3CNF.11.25.C03.1.454.CMB.2.raw
  modified_base (278)..(278): a, c, t, g, unknown or other
  modified_base (295)..(295): a, c, t, g, unknown or other
  modified_base (415)..(415): a, c, t, g, unknown or other
  modified_base (438)..(438): a, c, t, g, unknown or other
  modified_base (454)..(454): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggagaggcctgatccagcctggggggtccctgagactctcctgtgcagcctctgggttcaccggtcagtcacncctacatgagttggccncaggctccagggtaagggctggagtggctctttattacagcagtgtagtacatactccgcagactccgtgacggggccaaattccacatcaccagactaacaactcaaagaacacgcttnttacttcaaaagtcgaacagccngagacgaccggttaanacgacgaccggttacctagtaacttacgtgtacgacgaacggaacgtacggaccggggaccctaacggtaaccgtaaccgtacgacgtaacgtacggacggtaccggtacggggaccgaacgggtaccgtacgg

SEQ ID NO: 423755 - DNA, 594 bp, Homo sapiens
  misc_feature: GZ8MTXP02JWINO.11.25.C03.1.454.CMB.2.raw
  modified_base (346)..(346): a, c, t, g, unknown or other
  modified_base (376)..(376): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtccgcaggctccgaggggaaggggctgggagtgggtcttcctttatttacngcagtggtagtacatatccgcagactccgngcggggccattccacatctccagacgacaactctaaagaaccacgcttgtttcttacaaatgaaacagcctggagagccgatgaccgacggccgttagtattacgtgtgacgtagacggaggtcgggacccgtaacggaaaccgttcgtaaaccggcgttaaagtcggggtaaccgttcgggacgggggaacccaaagggggacccctaacccggggg

SEQ ID NO: 423756 - DNA, 749 bp, Homo sapiens
  misc_feature: GZ8MTXP02IP03P.11.25.C03.1.454.CMB.2.raw
  modified_base (300)..(300): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtcgtgggaggaggcctgactccagccgtgggggtccctgagctctcctgtgcagcctcgtgggttcaccgtcagtcacacctacatgagttcggccnccgaggcctcgaggggagggctggagtggtcttccgtttattacagctaggtggtaagtacacttacgttccgactacgtaccgtcccgggttagggaccggggggtccctaacgtttacccaaccccgtattacccgtaccgaaaggtaaacgaacctaaacctacgtaaaacgaacctaaccgttctttacgttttaacttaactaaaagtcgaaacacgtacccgtagaacggtacgacccgataccggaccgtaccgggtaccgttagttaacgttacgtaggtacggacggtaacggtacgggaacggttcccgggggaaacccctaaacgggttaaaccgtttaaaccggtaacccggttacgttaaagggtacggggtaaacccgggttcggggaaccgggggaaacccggtaaaaccgggggacccccgttaaacccgggg

SEQ ID NO: 423757 - DNA, 600 bp, Homo sapiens
  misc_feature: GZ8MTXP02I109H.11.25.C03.1.454.CMB.2.raw
  modified_base (273)..(273): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggtcaccgtnagtcacacctacatgagttcgggtccgccgaggcctccgaggggaagggctgggagtgggtcttccttttatttacgagtcgtaaggttggtaagttacaattacgttcccgacaacgtaccgttcccggtgggacgggggtccctaagttccacccgtatcctacgagagactaactactaaacgaacacgtcttcgtttcttacaatacgaacagcctagacgacgcgattacgaccgacggcgtagtactcgtgtgcgagagagtcggaccacgtaacgtacacgactaagtcggacgtcgacgggaccgacggaccgtaccgg

SEQ ID NO: 423758 - DNA, 725 bp, Homo sapiens
  misc_feature: GZ8MTXP02FSAQ6.11.25.C03.1.454.CMB.2.raw
  modified_base (174)..(174): a, c, t, g, unknown or other
  modified_base (281)..(281): a, c, t, g, unknown or other
  modified_base (625)..(625): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggngtccagtgtgaggtgcgtctggtggagtcgtgggaggaggcctgatccaggtcccggtggggggtccctggacgacttctcctgtgcagcctcgtggttcacccgtnacgtcaccacctacagttgaggttcgggcccgccgtaggccgtaccggaagggggaacggggtccgtaggggtaggttcggggttcctttaccgttttaacttaaccgaggtcgtaaggttcgggtaaacgttacaactttacgttcccgagtaacggtaccgtccgggttacggggacgggggtcccttaattacccgaccctacgttacctaccgagaaacgaacctaaccctaacgtaaacaaacgtacgttccgttagtttactaacctaaaagtcgaaataccgaccgtaggaacgacgacctacggtagacccgtacggggtccttaggttattacgnggtcgacggtaggacgtaggtccgggggacccctaagtaaccgttacgacgtactaaggtcggtaaccggtcggacggggacgaaccgggcctaaccggg

SEQ ID NO: 423759 - DNA, 628 bp, Homo sapiens
  misc_feature: GZ8MTXP02I41EP.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtgggttcaccgtcagtcacacctacatgagttcggccgccaggctccgaggggagggctggagtggtcttcctttattacagtcagtggtatacattactccgacacgtactcccgggtaggcgggggacccactttaccaccctatcctaccgaagaacgaacctaaacctctaaaagaaccctaaccgtcttcgttttacttacaaaagtacgaaacacgccctaggaacgacgccccgtaagtacgaccgtaccggtccgttagttaacttacgtgtcgacggagagacggtcggggaaccccaagtaaccgttacgcgtataaggtcggaccgttcggacggggaccaacgggtaccgtaccgg

SEQ ID NO: 423760 - DNA, 580 bp, Homo sapiens
  misc_feature: GZ8MTXP02I2L3H.11.25.C03.1.454.CMB.2.raw
  modified_base (272)..(272): a, c, t, g, unknown or other
  modified_base (282)..(282): a, c, t, g, unknown or other
  modified_base (293)..(293): a, c, t, g, unknown or other
  modified_base (330)..(330): a, c, t, g, unknown or other
  modified_base (343)..(343): a, c, t, g, unknown or other
  modified_base (350)..(350): a, c, t, g, unknown or other
  modified_base (359)..(359): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgctaattttaaaaggagtccagtgtgaggtgcgtcgtggtggagtctggaggaggcctgatccagccgtgggggtcctgagactctctgtgcagcctcgtggttcaccgtnagtcacactnatgagtggccncgagctcgagggaggctggagtggtctctttattacngcagtgtagtacntattcgnagactccgngagggggccattaccacctagtcctacgaagacgaaactaaacctactaaaacgaactacgtctttacgtttacttaacaaaatcgaaacagtaccgtagaacgacgacctaagacgaacgacggtcctagtacttactgtcgagagagacgtccgggaccaacggtaacttacgacacgtaagtcggtacgtacggtagggaccaacgggtacgaaccgg

SEQ ID NO: 423761 - DNA, 675 bp, Homo sapiens
  misc_feature: GZ8MTXP02F4Q1C.11.25.C03.1.454.CMB.2.raw
  modified_base (342)..(342): a, c, t, g, unknown or other
  modified_base (406)..(406): a, c, t, g, unknown or other
tcagcgagagataccacgaccggtgctcgatttagtagtgtagatttgggtttgggggagaggagcccagcaatgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctggagactctcctgtgcagcctcgtgggttccaccgtcagtcacacctacatgaggttggccgccaggcctccgaggggagggctggagtggtctctttattacngtcagtgtagtacatactccgatacgtaccgtccggtagggcgggggccctagttaccaacctnttccgaccgaaggaactaaccctaaaccgttacaaaacggaaacctaccgtactttacgttttaccctaacgtaaaatacggaaacctagggtcccttaggaaacgttacggccccgaagtccgaaacccgtccggggtaccttagttaaactttcgaggcgacgtaggtacggacggtcggggaaccccctaaaggtaaccgttacgcccggtagtaacgtacggggaccgttcggacgggggaacccgacggggaccctaacccggg

SEQ ID NO: 423762 - DNA, 750 bp, Homo sapiens
  misc_feature: GZ8MTXP02G9QXU.11.25.C03.1.454.CMB.2.raw
  modified_base (260)..(260): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgatccagccgtgggggtccctgagactctcctgtgcngtcctcgtggtcaccgtcagtcacacctacatgaggttcggccgcgaggcctaccggaggggaacggggcgtagggtaggttcggttcctttaccttttagttacgacggtcgtaaggtggtaaggttaactaacgttaccgttccgaccgtaacgtccggttaccgggttacggggaccggggggtcccttaaacggttacccgaaccctacgttacccgtacccgaaagggaccaaacctaaaaccgttaacgtaaaacgtaacctaaccggtttctttaccggtttttaccttaaacgtaaaagttacgaaaacgacgtcccgtaggaacggacggaccgtaagtacggaacccgtacggtccgtttaagttacgttacgtggtacgacggtaggaggtacggtaccgggacctaaacggtaaccgttacgacgtaccgttaaggccggtacggtcggtacggggaccgtaaacgggcccgtaacgg

SEQ ID NO: 423763 - DNA, 779 bp, Homo sapiens
  misc_feature: GZ8MTXP02GPGQO.11.25.C03.1.454.CMB.2.raw
  modified_base (257)..(257): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtgggaggaggcctgatccgagccgtgggggtccctggagactctctgngcagcctcgtgggttcaccgtcagtccacacctacagtggaggttccgggtccgccgacgggccgtaccggaaggggggaaaggggtcgtaggggtaggttcggggtttcctttaccgtttttaagtttacgaggtacgtagggtaggtaacggtaacctaattaccgttcccgagtaccgtacgtcccgggttagggaccgggggccctagttcccaacctactccctaccgaagtaaccgaacctaaaccgttacaaacggaaccaacgttcttacgttttaacttaacaaaagttcgaaaactcggtaccctaggaacggaacgccgaacgtacgaacccgaccgggtcgttagttaacttaccggttgagaccggtaagacgggtacggtccccgggggaaaccctaaaccgggttaaaaccgtttaccgtaaccggttagtaacgggttacggggtaacccgggtaccggtaccgggggaaacccggttaaaccgggggaacccgttaaccccgggg

SEQ ID NO: 423764 - DNA, 665 bp, Homo sapiens
  misc_feature: GZ8MTXP02GYIV1.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtgggaggaggcctgactccaggccggtcggggggtccctggacgactcttcctgtgcacgtccttcgtcggttccaccgtcagtccacacctacatgagttcgggcccgcgaggcctaccgaggggacgggctggaggtcggttcttcctttatttacagtctaggtggtagtacatacttccgcagcctccggtgggcgggggcctaattcccacctactcctaccaaggtaacgaacaaacctacgtaaaggaacctcgtactttacgtttactaacgaaaattcggaaacagtacctaggacggacgtccggtaatcggaacccgtacgggtaccgttagttaacgttcgtaggtgaccggaaggaacggtcgggtacgggacccgtaaacggtaccgttacacgtactggtacggtaccgtcgggacgggaccggaacgggacctaccggg

SEQ ID NO: 423765 - DNA, 724 bp, Homo sapiens
  misc_feature: GZ8MTXP02HWXRW.11.25.C03.1.454.CMB.2.raw
  modified_base (177)..(177): a, c, t, g, unknown or other
  modified_base (264)..(264): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtcgtccgtgtcccaggacagacagccagaactccctgctctggaattgaattgagagataaatatacttgtgtatacaacagaanccatcgacctacgtcccctagtatttcggactattactatacaagagttaggacgacgcggtaccctacggacgggtactcccgtaggaccgtacgttacttcctacgtcggtacccttaccgtacgtcgtacgggaaaccgccgacgtcccacttccgacgacctagtccacgggcccgggaaaccctacggggtaccttaaagggtggaagttacggacggtaccgtttacgggttaaacctttaaggtttttaacggttaggttacccggggtaacgggttacccggggttaaggggaaaccctaggggaccctaacggtaccgtaccgtacccggtttaccgttacgtttacgggttacccgtttaacgggaaacggttcggggaaacccttaacgggtcctaaacccggttgttaacggtaccgttacgaacccggaccctaacccggaaccccg

SEQ ID NO: 423766 - DNA, 605 bp, Homo sapiens
  misc_feature: GZ8MTXP02FWWTY.11.25.C03.1.454.CMB.2.raw
  modified_base (298)..(298): a, c, t, g, unknown or other
  modified_base (362)..(362): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctaattttaaaaggagtccagtgtgaggtgcgtcgtggtggagtcgtggaggaggcctgatccagccgtggggggtcctgagactctcctgtgcagcctcgtggtcaccgtcagtcacacctacatgagttcggccnccaggctccgaggggagggctggagtggtctctttattacagtcagtgtagtacatacttccgnacgactccgtaggcgggggccattccacctatctccaagacgaacaaactacaaagaacacgtcttcgtttactacaaaatacgaaacacgcctagaacgtacgcccgtaagtacgaacccgtacgggccgttagtaactttacgtgtacgacggaagaggacggtcggggacccaaacggtaaacgttaccacgactaagtcggacgttcggacggggacccgaacggggacccgtaaccgg

SEQ ID NO: 423767 - DNA, 706 bp, Homo sapiens
  misc_feature: GZ8MTXP02GTYTC.11.25.C03.1.454.CMB.2.raw
  modified_base (304)..(304): a, c, t, g, unknown or other
  modified_base (311)..(311): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgagccgtgggggtcctgagctctctgtgcacgcctcgtggtcaccgtcagtccacacctacatgagttcggccncgacgcnccgaggggaggcgtggagtcggtcttctttattacagcgtagtggtatactactcgtaccgcacgcgtacccggtggcgggggtaccctatttacccgaaccctacgtacccgtaccaaaggtaaccgaaacctaaacccgtacgtaaaacgaaacccgacgttaccttttacggtttactttaaaccgaaaagttacgaacccgaacgtcccgttaggaacgacggacccgtagtaccggaccgtaccgggtaccgttgttacgttacttggcgacggtagtacggacgggtaccggggacccctaaacggttaaccgttaccgtaccggacgtaacggtcgggtaaccgttcgggtaccgggggacccgtaaaccggggaccccggtaaccgg

SEQ ID NO: 423768 - DNA, 699 bp, Homo sapiens
  misc_feature: GZ8MTXP02JTUM9.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagtactctcctgtgcagcctcgtgggtccaccgtcagtcacacctacatgaggttcgggccgccgaggcctccgaaggggaacggggcgtgggaggtcggggttcttaccgttttaatttaccgagtcgaaggttggtacgtacaacttacttccgcacgtacctccggtacggcgggggaccctattccgaccctacgtacctaccgaagaacgaactaaacctccgtaaaacgaaccaacgtctttcgttttaccttaactaaaagttacgaaacgtagccctaagggacggaacgccgtaacgtacgaacccgtacgggtacccgtgttaaacgttcgtaggtacgcggaagaggacgttccgggggacccaacgggttaaccgttaaccgtaccggtcttaaggtcgggtaaccggttcggtacggggacccgaaaacggggccctaacccgggg

SEQ ID NO: 423769 - DNA, 599 bp, Homo sapiens
  misc_feature: GZ8MTXP02HO6MG.11.25.C03.1.454.CMB.2.raw
  modified_base (176)..(176): a, c, t, g, unknown or other
  modified_base (277)..(277): a, c, t, g, unknown or other
  modified_base (320)..(320): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccacctnagtgtccgtgtccccaggacagacagccagaactcccctgctctaggtaattgaatgagagataatatacttgtgtatcaacagaacgcaggccagtcccngttatgtcatctatacaagatgagacgccgcctgaggctccgngacgccgtattctcgtgcctaccaactcgtacgggaacacgcgaccgactcacgacctagaccgacggaccccgggacccgagggtacttaggtacggaaggtggacgggtacctaggtaactttaatttaaggtttcggtacgtacggggcgtacgggggaaccgaggacgtacgacgtaccgtcgtacccgttagtccgttacgtacggaacgtacggtaacctacggtaccgtaccgttcgtacgtacgacgaccgacccgaaccgaccccaaccg

SEQ ID NO: 423770 - DNA, 766 bp, Homo sapiens
  misc_feature: GZ8MTXP02IQW2Z.11.25.C03.1.454.CMB.2.raw
  modified_base (262)..(262): a, c, t, g, unknown or other
  modified_base (264)..(264): a, c, t, g, unknown or other
  modified_base (283)..(283): a, c, t, g, unknown or other
  modified_base (293)..(293): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagcttggggtttttccttgttgcttaattttaaaaggagtccagtgtgaggtgcgtctggtggagtcgtgggaggaggcctgatccgaggccgtgggggtccctgagactctctgtncngcctcgtcggtcaccgtcngtcacactanatgaggttccggccgcgacggtcctaccggagggggacggtcgtgggaggtcgggttccttaccgtttaattacgagtcgtaaggtggtaactactacttacgtccgacgtacgtaccgttccgggtaggggaccgggggtacctacgtttacccaccgtaacctttccgtaaccgaaacgggaaacaaacccttaaaccgtaaaccgtaaaacgaacccgtaaccggttacctttacggtttaacccttaaacgtaaaacgttacgaaaccgtacgtacccgtaaggaccgtacgacccgtaagtaccgacccggtacggtaccgttagtaacgttccggttgacggacgtaggaacggacggtacccggggaaccccgttacggtaaacccgttaccgtacccgtagttaacggtacggggtaccggttcggggaaccggggtacccgggaaacggtaccccgtacccggg

SEQ ID NO: 423771 - DNA, 640 bp, Homo sapiens
  misc_feature: GZ8MTXP02F70SK.11.25.C03.1.454.CMB.2.raw
  modified_base (341)..(341): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttcgggtccgccaggctccgaggggagggctggagtggtcttctttattcngcagtgtatacatactccgcagactccgtggacgggggccattccacctatcctacagaacacaacgtactaaacgaacacgtctcgtttacttaacaaatacgaaactacggaccctaggaacggtacgccgaagttacgaaccgtaccgggtccgttagtaactttaccgtaggtacgacgaaggaggtacggtaccgggggacccctaaacggtaaaccgttaccgtacggtaccgtaagtcggggtaaccgttacggggacgggggaacccgtaaacggggacccgtaacccggg

SEQ ID NO: 423772 - DNA, 738 bp, Homo sapiens
  misc_feature: GZ8MTXP02HXTTQ.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacagtgagttcgggtcccgccaggcctaccgaagggggaacggggcgtgggaggtcgggtcttccgtttatttacgagtcaggtggtaagtacatacttccgactagtaccgtccggtggcgggggtcctaatttccaccctatccgtaccaaggacgaacctaactactaaacgaaaccacgtctttacggtttttacctaaacgtaaaacgttacggaaaacctacggtaccccttaggaacggtaacggaccccggtaaagtaccggaaaccgtacccggggtacccgtttaaggttaactttaccggtaggtacgggacggtaaggaacgggtaacggttaccgggggaccccctaaaacggtaaccgtttaacccgtaacgtacgttaacggtacgggtaccggttcgggacgggggaaccccgaaacgggggtaccccgtaacccggg

SEQ ID NO: 423773 - DNA, 666 bp, Homo sapiens
  misc_feature: GZ8MTXP02I5L9E.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggagtccagtgtgaggtgcgtctggtggagtctggaggaggcctgatccagccgtggggggtccctgagactctctgtgcagcctcgtgggtcaccgtcagtcacacctacatgagttcgggtcccgccgaggcctccgaggggaggggctgggagtgggtctcctttattacagcagtggtagtacatatccgcagactccggtggcgggggcctatccaccatctaccagacgacaactactaaacgaaccacgtcttgtttacctacaaatcgaaacaggccctaggaacgtacgcccggaagtacggaaccgtaccgggtaccgttagttaactttaccgttgggtacggaccggtaaaggtacgggaacggttaccggggggaccccctaaaacgggttaaacccggtttaaccgtaccggtaccgttaaggttcggggaaccggttcgggtacgggggaccccgtaaacgggggaccccgtaaccgggg

SEQ ID NO: 423774 - DNA, 602 bp, Homo sapiens
  misc_feature: GZ8MTXP02G0UO2.11.25.C03.1.454.CMB.2.raw
  modified_base (372)..(372): a, c, t, g, unknown or other
  modified_base (401)..(401): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctctggggtcaccgtcagtcacacctacatgagttcgggtcccgccgaggcctaccgaggggaaggggctgggagtgggtctcctttattacagcagtggtagtacatacttccgnagactcggtgcgggggcctattccacctntcctccaagacgacaactactaaagacctacgtcttgtttacttacaaatcgaaacagccctagacggagcccgagtacgaccgaccgggtccgtagtacttacgtggtgtaggagacggagtccgggggacccaacggtaaaccgttacaccggtactaagtcggtacgtcggtacgggggaccaacggggacccaccgg

SEQ ID NO: 423775 - DNA, 737 bp, Homo sapiens
  misc_feature: GZ8MTXP02JFY53.11.25.C03.1.454.CMB.2.raw
  modified_base (176)..(176): a, c, t, g, unknown or other
  modified_base (301)..(301): a, c, t, g, unknown or other
  modified_base (580)..(580): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggngtccagtgtgaggtgcgtctggtggagtcgtgggaggaggcctgactccaggccgtgggggtccctgagactctcctgtgcagcctgtcggtcaccgtcagtcacacctacatgagttggtcccncgaggctccgaggggagggctggagtcggtcttcctttattacagctagtggtaagtactacttacgtccgctacgaccgttccggagggaccgggggtcctacttaccgaaccctacgttcccgtaaccgaaacggtaaccgtaaacctaaaccttaacgtaaaacgtaaacccgtaccggttactttacggttttaccttaaactaaaaacgttacgaaaccgtacgaccgtaggaacgtacgaccgagtacgaccgaccgtcgtagttaacttcgnggtacgtacggacggtaacggtacggtacccgggggtaaacccctaaacgggttaaaccgtttaaaccggtaaccggttaccgtaaacggttacggggtacccggttaccggggtaccggggaaccccgggtaaaacgggtaccccgtaacccgggg

SEQ ID NO: 423776 - DNA, 632 bp, Homo sapiens
  misc_feature: GZ8MTXP02HUCEC.11.25.C03.1.454.CMB.2.raw
  modified_base (300)..(300): a, c, t, g, unknown or other
  modified_base (365)..(365): a, c, t, g, unknown or other
  modified_base (464)..(464): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttccaccgtcagtcacacctacatgagttcggccncaggctccgaggggagggctggagtggtcttctttattacagcgagtaggtagtacatactccgnacgtacgtccggtggacgggggcctatccacctatcctaccagacaacaaactacgtaaagaacctcgtcttacgttttactaacgaaaattcgaaacncggtaccgtaggaacgacgaccgaatcgaccgacggtccgtagttaacttacgtgtacgcgaaggacggacggtccgggacccctaaacggtaaaccgtttaccgacgtacgtaaggtcggtaccggtccggtaacgggggacccgaacggggacccctaacccgggg

SEQ ID NO: 423777 - DNA, 745 bp, Homo sapiens
  misc_feature: GZ8MTXP02GO6XU.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgaggcccggtggggggtccctggacgactctcctgtcgcacgcctcgtcgggttcaccgtcagtcacacctacatggtagtcggtccgcaggctccggaggggaacgggctgggaggtcgggttccttccgttttaatttacgacgtcgtaggtaggtaagtactatacgttccgacgaacgtaccgtccggtagggaccgggggtcctaacttacccgaccctaatccctaaccgaagtaacgaaacctaaaccgttaaccgaaaacgtaaacctacccgttaccgtttacgtttttaacccttaacgtaaaataccggaaacacgtacccgtaggaaaggacgtacccgaagtacggaaacccgtacgggtccgttaggttaaacttcgttggacgacggaaggacggtacggtaccgggggacccctaaacggtaaccgttaaaccgtcgtacctaaggtacggaacggttccgggaacgggggaaccgtaaaccgggggaccgtaaccccggg

SEQ ID NO: 423778 - DNA, 597 bp, Homo sapiens
  misc_feature: GZ8MTXP02G5XOU.11.25.C03.1.454.CMB.2.raw
  modified_base (400)..(400): a, c, t, g, unknown or other
  modified_base (408)..(408): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttcgggtccgccgaggctccgaggggaggggctgggagtgggtctcctttatttacagcagtggtagtacatattccgcagacctccggtggcgggggccattccacctntctcaganacaaactcaaacgacacgtctagttctacaaatgaacagcctaggacgacgaccgtagtacgaaccgacggtccgtagtaacttagtggtagcggaagacgaggtccggggacccaacggtaaaccgttacctacgtacgtaacgtcgggaaccgtcggtcggggaaccaaacggggtaccaacccggg

SEQ ID NO: 423779 - DNA, 792 bp, Homo sapiens
  misc_feature: GZ8MTXP02GWOS7.11.25.C03.1.454.CMB.2.raw
  modified_base (295)..(295): a, c, t, g, unknown or other
  modified_base (321)..(321): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgaggcccggtcggggggtccctggacgtacctctcctgtcgcagtccctcgtcgggttcaccgtnacgtcacacctacatgagttcggccncgaggctccggaaggggagggcgtgggaggtggtccttacgtttatttacgagtcgtaggtggtaagtactagtactccgctagaccgttccggtgggacgggggtcctacgttaccaccgtacttcctacgaaacggaacgtaacctaaaacccgttacaaaacgtaaccgtacccgttaccgttttacgttttaccttaaaccgtaaaagttacggtaaaaccgaacggtccccgttaagggtaaacgggaccgggtaccccgaaaggttacccggaaaacccggaccccgggtttacccggttaagtttaacggttttacccgtagggtacggacccgggtaaaggaaccgggtaccgggttacccgggggaaacccctaaacgggtaaaccgtttaacgacggtaccgtaaggtaccgggtacgtccggggtacggggaacccgtaacggggtaaccccgtaccggg

SEQ ID NO: 423780 - DNA, 697 bp, Homo sapiens
  misc_feature: GZ8MTXP02HJMKP.11.25.C03.1.454.CMB.2.raw
  modified_base (279)..(279): a, c, t, g, unknown or other
  modified_base (291)..(291): a, c, t, g, unknown or other
  modified_base (410)..(410): a, c, t, g, unknown or other
  modified_base (568)..(568): a, c, t, g, unknown or other
tcagcgagagataccacgaccggtgctcgatttagtagtgtagatttggggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctgggaggaggcctgatccagccgtgggggtccctgagactctcctgtgcacgcctcgtcgggttcacccgtnagtcacacctanagtgtacggtcggccgcgacggccgtacggaggggacgggcgtgggaggttcggttccttacctttattacgagtcgtaggttaggtacgtactactacgtccgacgacgtcgtccggngggcggggacctactaccgacctactccgacgaacgaacaacctaacctacgtaaacgaacctcgttctttacgtttactaaacaaacgtacgaacctacgactaggacgaccgaccgtagtacggaccgtaccgggttacgttagttacgttacggnggtacggacggaacggtacggttaccgggacccgggtaacccttaaacggttaaccgttaccgtacgtacggtaacggtacggtaccgggtcgggtaaccggggaacccggtaaccggtacccgtccgg

SEQ ID NO: 423781 - DNA, 610 bp, Homo sapiens
  misc_feature: GZ8MTXP02FN20E.11.25.C03.1.454.CMB.2.raw
  modified_base (364)..(364): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttgggtccgccaggctccgaggggagggctggagtgggtctcctttattacagctagtggtagtacatatccgnagactccggtgacgggggccattcacctatctaccagacgacaaacttcaaagaaccacgtctgttttactacaaatcgaaacagcctaggacgagccggatcgaccgacgggtccttagttaacttcgtagtgacggtaagacgaggtccggggaccccaacggtaaccgtttaccgacgtacgttaacggtcgggtaaccgttaccgggcgggggaacccaaacgggggtaccccgtaaccggg

SEQ ID NO: 423782 - DNA, 608 bp, Homo sapiens
  misc_feature: GZ8MTXP02IHYQU.11.25.C03.1.454.CMB.2.raw
  modified_base (359)..(359): a, c, t, g, unknown or other
  modified_base (370)..(370): a, c, t, g, unknown or other
  modified_base (372)..(372): a, c, t, g, unknown or other
  modified_base (390)..(390): a, c, t, g, unknown or other
  modified_base (455)..(455): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtctggaggaggcctgatccagccgtgggggtccctgacgactctctgtgcagcctcgtgggttcaccgtcagtcacacctacatggagttcggccgccaggctccgaggggaggcgtggagtggtctcctttattacagcagtgtagtacatatccgnacgacttccgngngggggccattccacatcnccagacacgaactctaaagacacgtctgtttacttaagaaactcgaactaacgcctagaacgganacccgagtacgaccgaccgggccttagtacttacgtgtagaccgaaggaggacggtcgggggaaacccctacggtaaaaccgtttacacccgtagtaagtacgggtaccggttacggaccgggggaacccaacgggggaacccctaacccggg

SEQ ID NO: 423783 - DNA, 604 bp, Homo sapiens
  misc_feature: GZ8MTXP02FTXDF.11.25.C03.1.454.CMB.2.raw
  modified_base (454)..(454): a, c, t, g, unknown or other
  modified_base (491)..(491): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtccgtgtccccaggacagacagccagactcccctgctctggaattgaattgagagataaatattacttgttagtatacaacagaagccaggccacgtcccctgtattggtcatctatacaagagtgtagaacgccggccctgaacggactcccgtggacgtccgtacttcctcgtcggaccttacccgtaaacgttccgggtaacgggaaccgacgaccgccgtaacctcgtacgacccatccgacggaccgggacccgagactagtggagnggagtcctagtacttagttacgttggcgagggtacgnggacgagcgagctaaccgtcgtacccgtttatcgttacgtaccggacgtacggaccgtaaacgtccgtaacgtcgtacggtacgaccgacgacccgaacggacccgaaacccc

SEQ ID NO: 423784 - DNA, 420 bp, Homo sapiens
  misc_feature: GZ8MTXP02IMLP5.11.25.C03.1.454.CMB.2.raw
  modified_base (412)..(420): a, c, t, g, unknown or other
tcagcgagagataccacgaccggtgctcgatttagtagtgtagatttgggtttggggggagaggagcccagcactgggattccgaggtgtttccattcggtgatcagcactgaacacagagactcaccatggagttttggctgagcttgggtttttccttgttgcttaattttaaaaggagtccagtgtgaggtgcgtcgtggtggagtcgtgggaggaggcctgatccagccgtgggggtccctgagactctctgtgcacgcctcgtgggttccaccgtcagtcacacctacatgagttcgggccgccaggcacggccggccccgtggggctcgccgtggtacgaaaggtacttaccttccgtatcctcgtcgccgtggacggcgggtctggaccaacgggcgacagtagnnnnnnnnn

SEQ ID NO: 423785 - DNA, 582 bp, Homo sapiens
  misc_feature: GZ8MTXP02IWHTL.11.25.C03.1.454.CMB.2.raw
  modified_base (380)..(380): a, c, t, g, unknown or other
  modified_base (492)..(492): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagactctcctgtgcagcctcgtgggttcaccgtcagtcacacctacatgagttgggccgccaggctccgaggggtagggctggagtgggtctcctttatttacagcagtggtagtacatacttccgcaggacctccggtgngggggccattccaaccatcaccagagacaactacaagaacacgtacttgtttctacaaatgaacagcctgagagccgatcgacacggcctgttacttacgtgtcgacggagngaggtcggggacccaacggtaacgttaacgaccgtactaaggtacggaccggttcggtacggggaccgtaacggggacccgtaacccggg

SEQ ID NO: 423786 - DNA, 813 bp, Homo sapiens
  misc_feature: GZ8MTXP02JKOZ3.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtctggtggagtcgtggaggaggcctgactccgagccgtggggggtccctgagactctcctgtgcagcctcgtcggttcaccgtcagtcacacctacagtgaggttcgggtccgccgaggcctaccggagggggaacgggcgtgggaggttcggggtccttaccgttttatttacgagtcgtaggtggtaagtactaacgttacgttccgacaacgtaccgttccggtaggggaccgggggtccctaacgtttcccgaacccaacgttcccgtaaccccgaagggaaaccgtaaaccctaaaaccgttaccgtaaaaacgaaacccgtacggttaccttttaacggttttacctttaaaacgaaaaacgttcgaaaaccgttcggacccttaagggaaacggtaaccggtaccccgaagttacccgggaaacccgtaccggggaccccgttttaaggttaaacgtttaccggtggggtacgaaccggtaaagggacggtaaccggggtacccgggggaacccctaaaacgggtttaacccgttaacgtacccgtagttaacggtcggggtaaccgttacgggtaccgggggacccgaaacggggtaccctacccggg

SEQ ID NO: 423787 - DNA, 808 bp, Homo sapiens
  misc_feature: GZ8MTXP02J00SN.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtcgtggaggaggcctgatccagccgtgggggtccctgagactctcctgtgcagcctcgtggtcaccgtcacgtcacacctacagtgtaggttcggtccgcgaggcctaccgaaggggaacggggctgggacggttgggttccttacccgttttaatttacgacgtacgtaggttggtaacgtactaacgttacgttcccgacgtaacggtaccgtcccgggttaggggacggggggtcccgtaactttcccgaaccgtacttccgtaccgaaacggaacgtaaccaaaaccgttacctaaaacggaaccacgttccgtttacggttttacctttaaacgaaaacgttcgaaactacggtcccttaagggaacgtacgtaccccgtaagttaccggaaccgtaccggggttaccgtaaggttttaaccttacggttaggtacgggaccggttaaaacggggaggtaaaccgggttacccggggggaaaccccttaaacggggtaaaccccgttttaaacggacccgttactaacggggtttacggtaaaccggtttccggggaccgggggaaacccgtaaaacgggggtcccctaaaacccgggg

SEQ ID NO: 423788 - DNA, 629 bp, Homo sapiens
  misc_feature: GZ8MTXP02I5OJB.11.25.C03.1.454.CMB.2.raw
  modified_base (368)..(368): a, c, t, g, unknown or other
  modified_base (375)..(375): a, c, t, g, unknown or other
  modified_base (377)..(377): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttggtccgccaggctccgaggggaagggctggagtgggtcttcctttattacagtcaggtgtagtacatattccgcanactccgngnggggcctatccaccatctccagacgacaactacaaagacacgtctcgtttactacaaatacgaaacacggcctaggaacgtcgaccgacgtacggaaccgtaccgggacccgttaggttaacttaaccgttgtcggaaccggaaggtacgaacgggtcggggaaccccctaaacggtaaaccgttaaccgtaccgactaacgtcgggtaacggttcgtacgggggaccgaaaacgggggtacccaacccggg

SEQ ID NO: 423789 - DNA, 712 bp, Homo sapiens
  misc_feature: GZ8MTXP02JW6A1.11.25.C03.1.454.CMB.2.raw
  modified_base (242)..(242): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgctattttaaaaggagtccagtgtgaggtgcgtctggtggagtcgtggaggaggcctgatccaggccgtgggggtcccngagactctcctgtgcagcctcgtgggtccaccgtcagtcacacctacatggagtcgggtccgccacggcctaccggaagggggaacggggcgtgggaggttcggggttccttccgttttatttacgagctaggttggtagtactattacgttccgctaacgtacgtccggtgggacgggggccctacgttccaacctatcccgtaccaagaacgaacctaaactacgtaaaacgacctacgtcttagtttacctaactaaaatcgaaactacggcctaggacgtacgccgaatacgaaccgaccgggtaccgtaggttacttaccggtggtacgacggtaggaaacgggtacgggtacccgggggtaaccccaaacggttaacccgttaaaccgtaccggtacgtaacgtacgggggtaaccggttcggtaccgggggaacccgtaaacggggaccccgttaacccgggg

SEQ ID NO: 423790 - DNA, 548 bp, Homo sapiens
  misc_feature: GZ8MTXP02FNLBO.11.25.C03.1.454.CMB.2.raw
  modified_base (359)..(359): a, c, t, g, unknown or other
  modified_base (370)..(370): a, c, t, g, unknown or other
  modified_base (440)..(440): a, c, t, g, unknown or other
  modified_base (464)..(464): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctgggtcaccgtcagtcacacctacatgagttgggccgccaggctccaggggaagggctggagtgggtctcctttattacagcagtgtagtacatattccgnagactccgtgnggggccgattcaccatctccagagacaactctaaagaacacgctgtttctacaaatgaacagcctagagngccgatgacacggcctgtattacngtgacgagagaagtcgggggacccaacggaacgttactacgactaagtcgggacgtcgtcgggggaccaacggggcccaaccgg

SEQ ID NO: 423791 - DNA, 700 bp, Homo sapiens
  misc_feature: GZ8MTXP02FSL8U.11.25.C03.1.454.CMB.2.raw
  modified_base (177)..(177): a, c, t, g, unknown or other
  modified_base (256)..(256): a, c, t, g, unknown or other
  modified_base (299)..(299): a, c, t, g, unknown or other
  modified_base (554)..(554): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtgaggtgcgtcgtggtggagtcgtgggaggaggcctgatccagccgtgggggtccctgagactctcctgtncagcctgtggtcaccgtcagtcacactacatgaggttcggccnccgaggctccgaggggaacgggcgtgggagtgggttcttaccgtttattacgaggctaggtggtaagtactattacgttccgactaacgtacctccgggtagggacgggggccctaagtttccaacccgtattacctacccgaaaggtaacaaactaaaccctacgtaaaagaacccgtaacgttccgttacgtttttacctaactaaaagttacgaaaccgtacggcccttaggaacggtacgacccggttaanacggaacccgtacggtaccggttagttaaacgttcggagtcggacgtaaggagaacggttccggggaaaccctaacggtaacgttaccgacgtacgtaagtcggtacgtaccggtacgggggaaccaacgggggtaccctacccgg

SEQ ID NO: 423792 - DNA, 700 bp, Homo sapiens
  misc_feature: GZ8MTXP02IPD66.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagcttgggttttccttgttgcttattttaaaaggagtccagtgtgaggtgcgtcgtggtggagtcgtgggaggaggcctgatccagccgtgggggtccctgagactctcctgtcgcagccttcgtcgggttcaccgtcagtccacacctacatgtaggttcgggtccgccgaggcctaccgagggggaacggggcgtgggaggttcggggttcttaccgtttttattacgagacgtaggttggtaagtacagttacgttcccgactacggtaccgttccggtagggacgggggtccctattcccgaacctcgttactaccgaaagacgaacaaaccttacgaaaagaacctacgtctttcgttttactacgaaaattcgaaacacggtccctaggaacgtcgacccgtataccgaccgtaccggtacgtttagtaacttacgttagcgacggaaaggtacggtacggttacccggggaaccctaaacgggtaaccgttaaccgtacgtacgtaagtcgggaaccgttcggacggggaccgtaacgggaccctaccgg

SEQ ID NO: 423793 - DNA, 816 bp, Homo sapiens
  misc_feature: GZ8MTXP02GODJQ.11.25.C03.1.454.CMB.2.raw
  modified_base (177)..(177): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggngtccagtgtggaggtgcgtcgtgggtggagtcgtgggaggacggcctgactccgacggccgggtcggggggtccctggacgtacctccgtccgtggtcgccgacgtcccgttcggttcggggttaccacccgtcgacgtaccaacctacctacagtaggtacggttccgggcccgaccgacggtcctaccgggaaggggggtaacgggtcgtaggggtaggttcgggttcctttaccgttttaagttaccgaggtacgtaggttggtaaacgttacgacttacgttccgacgtaacgtccgtccgggtagggcgggggtacctagttacccaacctattcccgacgaagtaacgaacctaacgtaccgtaaaacgactaccgtcgtttacgtttacctaacgtaaaacgtacgaaaccgaccgttccggtagaacggtaaccgacccgttaagtaccggacccggaaccgggtcccggttaaagttaacgttaccggtggtacggacggtaaggacggtaaccgggtcccgggggaaaccccttaacgggtaaacccgttaccgtaccgtacgtttaacgggacggtaacccggttcggggaccggggaccggaaacccggggtcccgttaaccccggg

SEQ ID NO: 423794 - DNA, 586 bp, Homo sapiens
  misc_feature: GZ8MTXP02FJ52N.11.25.C03.1.454.CMB.2.raw
  modified_base (383)..(383): a, c, t, g, unknown or other
  modified_base (407)..(407): a, c, t, g, unknown or other
  modified_base (444)..(444): a, c, t, g, unknown or other
  modified_base (562)..(562): a, c, t, g, unknown or other
tcagcgagagataccacgaccggtgctcgatttagtagtgtagatttggggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggagaggcctgatccagcctgggggtccctgagactctcctgtgcagcctcgtgggttcaccgtcagtcacacctacatgagttggccgccaggcctccgaggggaaggggctgggagtgggtctaccgtttattaccgagtcagtggtagtacactattccgcagacctccggtgnggggccattcaccatcaccagganacaactcaaagacacgtctgtttctacaaatcgaacncgcctggacgagcccgaatcggaccgaacgggtcccgttagtaacttaccgtgttcgcggaagacggtaacgcggggaccctacggaaccgtttacaccgactaagcggacgtccggngggacccaaaggggtcccaacggg

SEQ ID NO: 423795 - DNA, 634 bp, Homo sapiens
  misc_feature: GZ8MTXP02I0230.11.25.C03.1.454.CMB.2.raw
  modified_base (252)..(252): a, c, t, g, unknown or other
  modified_base (256)..(256): a, c, t, g, unknown or other
  modified_base (267)..(267): a, c, t, g, unknown or other
  modified_base (358)..(358): a, c, t, g, unknown or other
  modified_base (371)..(371): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctgggggtccctgagctctcctgtgcngctntggtcaccgtnagtcacaccacatgagttcgggcctcgacggctccaggggaagggctggagtggtcttcctttatttacagtcagtgtagtcagtatccgnacgactccggtgngggggtccaagttccacctatcctccaagacgaactaactactaaacgaaacacgacttgtttacttacaaaattacgaacacgtaccttaggacggaacgcccgtaagtcgaaccgacgggtaccggttagtaacgtttacgtggtagaccgtaaggacgagtcgggggaacccaacggtaaaccgtttaacgacgtacgtaacgtacgggtacggttaccggttacgggggaccctaaacgggggacccttaaacccgggg

SEQ ID NO: 423796 - DNA, 798 bp, Homo sapiens
  misc_feature: GZ8MTXP02HS8DA.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgagccggtcggggggtccctgacgactctcctgtgcacgcctcgtggttccaccgtcagtcacacctacatgaggttcggtcccgcaggtcctccggaagggggaacggggtctggggtaggttcggggttcctttacccgtttttaagtttaccgaggtaccgtaagggtttagggttaaacgttaaccgtaactttaaccgtttcccccgacgtaaccggtaacccgttccccggggttaaggggacccggggggtacccttaacgtttcccgaaaccccttaacgttccctaacccgtaaaggaaacgtaaaccctaaaaccttacgtaaaacgtaaacgttaaccgttctttacgttttacttaaacaaattacgaaactagtcccgtaggaacggtacgaccgtataccggaacgtaccgggtccgttagttacttacgttggcgtacggaagacggtacggccggggaacccctaaacggtaaccgtttacgaaccggtacgttaacggtcggtaaccggttcgggaaccggggaacccggaaccggtacccggtaacccgg

SEQ ID NO: 423797 - DNA, 669 bp, Homo sapiens
  misc_feature: GZ8MTXP02G5GMJ.11.25.C03.1.454.CMB.2.raw
  modified_base (286)..(286): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtcgtggaggaggcctgactccagccgtgggggtccctgagctctctgtgcacgcctcgtcggtcaccgtcagtcaccactacngtgagttcggtccgcgaggcgtccgaggggagggcgtgggacgtgggtccttactttagttacagcgtaggtggtagtacagtacttccgacagtaccgtcggtagggacgggggtcctaattaccgacctacgttccgacccgaaggtaaccgaacctaaaccgttacaaacgaactaccgtctttacgttttacctaaacgtaaaatacgaaaccgtacgcccgttaaggaacgtacgaccggtaagtacgaaaccgtaccggtcgttagttaacgttacggtgtacgacggtaggagtcggacccggggacctaaacggtaaccgttacgacgtacaaggtcggtacggttacggacggggaccaacggggacctaccgg

SEQ ID NO: 423798 - DNA, 699 bp, Homo sapiens
  misc_feature: GZ8MTXP02GGBT9.11.25.C03.1.454.CMB.2.raw
  modified_base (174)..(174): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggngtccagtgtgaggtgcgtcgtggtggagtctggaggaggcctgatccagccgtgggggtccctgagactctctgtgcacgcctcgtggtccaccgtcagtcacacctacatgagttcggccgcgaggcctaccggaaggggaaggggtcgtagggtaggttcggggttcctttaccgttttaatttacgacggtcgtaggttaggtaacgtactaacgtttacgtccgacgtacgtaccgtcccggttagggacgggggtccctaacttaccgaacctacgtaccctaccgaacgaaacgaacctaaaccgtactaaaacgaactacgtactttacgtttactaacgtaaatacgaacctagtcctaaggacgtacgaccgatacgaaccgcggtaccgttagtaacttcgtagtacgacggtaaggacggtacggtaccggggaaccctaaccggttaaacgtaccgtaacgtacgtaacgacgggtacgtccggacgggaccggaacgggaccctaacccggg

SEQ ID NO: 423799 - DNA, 643 bp, Homo sapiens
  misc_feature: GZ8MTXP02F2FVO.11.25.C03.1.454.CMB.2.raw
  modified_base (278)..(278): a, c, t, g, unknown or other
  modified_base (290)..(290): a, c, t, g, unknown or other
  modified_base (342)..(342): a, c, t, g, unknown or other
  modified_base (366)..(366): a, c, t, g, unknown or other
  modified_base (583)..(583): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgatccagccggtggggggtccctgagactctctgtgcagcctcgtggtcaccgtnagtcacacctantgaggttcggccgcaggctcgaggggaggctggagtggtcttctttattacngctagtgtatacatacgttccganagacctccgtaggacgggggcctattccgaccactactaccgaagacgaaacctaaactacgtaaagactaacgtcttacgtttactaacgaaatacgaaacacgtacctagaacggcgaccgaagacgaacgtacccggggtcgttagttacgttagtggtcgaggaaggaggtacgggtaccgggaacccgtaaacggtaaacctttaccggacncgttaaaggtcggtaacgggttccggaacggggaccgtaaaacggggaccctaaacccgg

SEQ ID NO: 423800 - DNA, 560 bp, Homo sapiens
  misc_feature: GZ8MTXP02G4N4Z.11.25.C03.1.454.CMB.2.raw
  modified_base (299)..(299): a, c, t, g, unknown or other
  modified_base (364)..(364): a, c, t, g, unknown or other
  modified_base (373)..(373): a, c, t, g, unknown or other
  modified_base (423)..(423): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagcctggggggtccctgagactctcctgtgcagcctctggggttcaccgtcagtcacacctacatgagttgggccnccaggctccgaggggaggggctgggagtgggtctcctttattacagcagtgtagtacatatccgnagactccgnggacggggccattccacatcaccagacacaactcaagacagctgttctanaaatgaacagcctgagagccgatcgacacgggcctagtacttacgtgtacgcggtagacgtagacgggggacccaacggtaaccgttactacgacgtaagtcggacgtcggtcggggaaccaaggggtacccacggg

SEQ ID NO: 423801 - DNA, 596 bp, Homo sapiens
  misc_feature: GZ8MTXP02JIENJ.11.25.C03.1.454.CMB.2.raw
  modified_base (392)..(392): a, c, t, g, unknown or other
  modified_base (404)..(404): a, c, t, g, unknown or other
  modified_base (408)..(408): a, c, t, g, unknown or other
  modified_base (431)..(431): a, c, t, g, unknown or other
  modified_base (441)..(441): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtccgtcgtccccaggacagacagccagaactcccctgctctaggaattgaattgagagaattaaatattacttgttggtatacaaacagaacgccaggcccacgtcccctgtattcggtctatctatacaagattgagaacgcccggcctcggaggtactcccgagacgccgtacttcgtcgtcggcctaccgaactcggtacgggaacncgacgccactcncacncacgacggccggaccgtgctagngagtgacgtntagtacttattcgttgacggagggtcgtggaacgaggcacgcctacgtcgtaccgtttacgtcggttcgtaccgggtaacgtaccggggtaaccgtacggtcctaccggttgttacgacgttaccgaccggtacccgaaccggccctaaaccccg

SEQ ID NO: 423802 - DNA, 686 bp, Homo sapiens
  misc_feature: GZ8MTXP02GJQ6Q.11.25.C03.1.454.CMB.2.raw
  modified_base (313)..(313): a, c, t, g, unknown or other
  modified_base (411)..(411): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcacgcccaccctcaggtcgtcccgtcgtccccaggacagacagccagaactcccctgctctggaattgaattgagagaataatattacttgttgtatcaacagaagccgaggcccacgttccccgtgttacttcggtactatcctanacgtaagtatggtagaacgccggccctacgacgggacttcccgagacggccgtacttccgtcgtacggtcctacccaacgttcggtacggggaaaccncgaaccgcccacttctacgacccagtaccgacggaccggacccgagggtctagtagggactagggacgtactagtaaccttagtttacgttgaccggtaaggggtccgggtaacgggacacggaccacgaccgtaccgtccgttaaccccggttagttccggtttaccggtaacgggtaaacccggtacggggtaaccgtaaacggttccctaaccggttcgtttaccggacgtaccggaaccgaaccccggaaccggacccccttaaaccccgg

SEQ ID NO: 423803 - DNA, 573 bp, Homo sapiens
  misc_feature: GZ8MTXP02F8VY3.11.25.C03.1.454.CMB.2.raw
  modified_base (360)..(360): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtcctgagactctcctgtgcagcctcgtgggttcaccgtcagtcacacctacatgagttgggtccgccaggctccgaggggagggctggagtggtctctttattacagcagtggtatacatattccgnagactccgtgcggggccattcaccatctcagacacaactcaaagaacacgtctgtttactacaaatcgaacagcctaggacgagcccgaatgaacccgtacgggccttagttacttacgtgtgcgaaggtagacgtcgggggaccctaacggtaacttacgacgctaagtcgggaacgtcggtacgggggacccaaacgggggacctaccggg

SEQ ID NO: 423804 - DNA, 677 bp, Homo sapiens
  misc_feature: GZ8MTXP02IJSWG.11.25.C03.1.454.CMB.2.raw
  modified_base (276)..(276): a, c, t, g, unknown or other
  modified_base (297)..(297): a, c, t, g, unknown or other
  modified_base (383)..(383): a, c, t, g, unknown or other
  modified_base (401)..(401): a, c, t, g, unknown or other
tcagcgagagataccacgaccggtgctcgatttagtagtgtagatttgggtttgggggggagaggagcccagcactgggattccgaggtgtttccattcggtgatcagcactgaacacagaggactcaccatggagttttggctgagctgggttttccttgttgctatttaaaaggagtccagtgtgaggtgcgtctggtggagtcgtgggaggaggcctgatccagccgtgggggtccctgagactctcctgtgcacgctcgtgggtcaccgtcngtcacacacatgagttggccnccgacgctccgaggggagggctggtacgtggtcttacctttagttcagcagtggtagactatacgtcgactagaccgtcggtcggngggggcctacgtcacccntccgtacagaacgaacaacttacgaaacgtaaaccgacgttacgtttacgttttactaactaaaactacgaaaccgacgtcccaggaacggacgacgaagcgaaccgtacgggaccgtttaggttaaacttccgttagggtacgacggtaaggtaacgggcgggtaacgggggtaacccccaacgggtaacccgttaaaacgtccggtactaaacggtccggggtacggtaccgggttacggggaaacccgggtaaacggggacccgtaaccccgg

SEQ ID NO: 423805 - DNA, 696 bp, Homo sapiens
  misc_feature: GZ8MTXP02FPBK0.11.25.C03.1.454.CMB.2.raw
  modified_base (308)..(308): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtcgtccccaggacagacagccagaactccctgctctaggaattgaattgagagaataaatatacttgttaggtatacaaacagaaagccagccacgtcccctgttattggtcatctatcaagntgtagaagccggcctcgaggactcccgtaggacgccgtacttcgtcgtcgggactaccctaacgtcgtacggggaaacgtaccgacgtccctaacttccgtacggaaccctacgttacccggaacggtacccgggggaaaccccgtaagggtacccgttaaggtacgggtaagttacgggaaacgggttacgtacggttaaaccttaagttttacggttacggttacccggtaagggggtccggttaagggggaacctacgggacaacggcctaacgtccgtaccccgtttagtcggttacgttacggaaaccggttcggaaacccgtaggtccctaaacggtcgttaacgacgtaccgaccggaccgaaccggaccccctaaacccg

SEQ ID NO: 423806 - DNA, 582 bp, Homo sapiens
  misc_feature: GZ8MTXP02JRTIR.11.25.C03.1.454.CMB.2.raw
  modified_base (269)..(269): a, c, t, g, unknown or other
  modified_base (371)..(371): a, c, t, g, unknown or other
  modified_base (420)..(420): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtcgtccgtcgtccccaggacagacagccagaactcccctgcctctaggattgaattgagagataaatatacttgttgtatcaacagaacnccacggccacgtcccctgtacttggtctatctatacaagatgtagacgcggcctgaggactcccgtgagccgtattctcgtcgctaccactcgtacgggacncgtacgcctactcgtacgacctagtcgacgcccggaccaggctagtggntaggacgctagacttattcgttgacgtagggtacggtacggacgtcggacacggtacctgtaccgtcccgtttagtcgttacggttaccgggaacgttcggaaccgtacggtctaaccggtcgttacgaactcggtaaccgaccgtaccggaccctaacccg

SEQ ID NO: 423807 - DNA, 746 bp, Homo sapiens
  misc_feature: GZ8MTXP02IIJW5.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggtagttttggctgagcttgggttttccttgttgcttaattttaaaaggagtccagtgtgaggtgcgtcgtggtggagtcgtgggaggaggcctgactccgacggccggttcggggggtccctggacgtaccttctccgtgtcgcacgtccttcgttcggggttaccacccgtcacgtcaaccacctaacatggtaggttcgggccgccaggcctaccggagggggaacggggtctgggaggttggttccttacttttatttacgagctaggtcggtaagtactacttacgttccgacacgtacttccgggagggcgggggtccctaattcccaaccgtactccgtaccaaagtaacgaacaactaacgtaaagaaacctacgtctttcgtttactaacaaaagtcgaaacacgtacctaggaacggtacgcccgtagtacgaaacccgtacgggaccgtttagttaaccgtttatcgggtacgacggtaaggtacggacgggtacccgggggtaaacccctaaacggttaaccggtttaaccgttacggacgttaaggtaccgggtaacgttccggggaacgggggacccgaaaacggggtacccgtaaccccggg

SEQ ID NO: 423808 - DNA, 658 bp, Homo sapiens
  misc_feature: GZ8MTXP02JTYC7.11.25.C03.1.454.CMB.2.raw
  modified_base (222)..(222): a, c, t, g, unknown or other
  modified_base (245)..(245): a, c, t, g, unknown or other
  modified_base (257)..(257): a, c, t, g, unknown or other
  modified_base (389)..(389): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtccgtgtccccaggacagacagccagactcccctgctcgnggattgaattgagagtataaatntatgttagtatnaacagagcagccagtccctgtagtgtacatctatcgaatatggtagaaggccggccctacgagggactcccgtaggacgccgtacgttccgtacgtcggtaccaccgttaacgttccggtaacgggggtacncgaaccgcccgtaaacttctacggaaccctactaccgaaccgggtcccgggaacccgaagggcccttaggtacgggtagtaaccggggtacgtaccgttaaacgtacgtttacgtttacggttacggtaacggtacggggtacggtacgggtacgacggagacgtaccggtaccgtacgttaccgttacgttacgttacggtacggtacggtacggtacgtacgtacgtaccgtcgtacgtacgtacgaccgaccgaccgaccgacccg

SEQ ID NO: 423809 - DNA, 741 bp, Homo sapiens
  misc_feature: GZ8MTXP02JH98O.11.25.C03.1.454.CMB.2.raw
  modified_base (300)..(300): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggagcctgatccagccgtggggggtccctgagactctcctgtgcagcctctgggttcaccgtcagtcacacctacatggaggttggtcccncgaggctccgaggggagggctgggagttgggtcttaccgtttattacgagcgagtggtaagtaccattaactttcccgactacggtaccgttaccggtagggtaccgggggcctaaacgttccaaccctattcccgtaccgaggaaacgaacctaaacttaccgtaaaagaacccgtaacgtccttaggtttttacctttaacgaaaattacggaaaacacgggtacccgttaggaacgacggtacccgaattacggaaccgaaccgggttcccgttaggttaactttaccgttagggacgtacggaacgggaaggtacggttacccgggggaccccttaaaccggtaaccggtttaaaaccgtccgggtaacttaacggtccgggggtaaccgttccggggttacgggggaacccgtaaaccggggacccggttaaccgg

SEQ ID NO: 423810 - DNA, 591 bp, Homo sapiens
  misc_feature: GZ8MTXP02GSHV1.11.25.C03.1.454.CMB.2.raw
  modified_base (343)..(343): a, c, t, g, unknown or other
  modified_base (363)..(363): a, c, t, g, unknown or other
  modified_base (372)..(372): a, c, t, g, unknown or other
  modified_base (390)..(390): a, c, t, g, unknown or other
  modified_base (406)..(406): a, c, t, g, unknown or other
  modified_base (413)..(413): a, c, t, g, unknown or other
  modified_base (437)..(437): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttattttaaaaggagtccagtgtgaggtgcgtctggtggagtcgtggaggaggcctgatccagccgtggggggtccctgagactctctgtgcagcctcgtgggttcaccgtcagtcacacctacatgagttcggtccgccaggctccgaggggaagggctggagtggtcttctttattacngcagtgtagtacatactcgnacgactcgnggcgggcattccacatcncagacacaactcaaanacacgtnttcgtttactacaaagtcgaaacngtaccgtaggacgacgaccgtaatccgaaccgtaccggtcgttagttaactacgtggacgcgaaggtacgaggtcccggggaccaacgtaaacgttaccgtacgtcgtaagtcggaaccgtcgggtcggggacccgtaacgggacccgtaacgg

SEQ ID NO: 423811 - DNA, 723 bp, Homo sapiens
  misc_feature: GZ8MTXP02G2W7G.11.25.C03.1.454.CMB.2.raw
  modified_base (298)..(298): a, c, t, g, unknown or other
  modified_base (319)..(319): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagctgggttttccttgttgcttaattttaaaaggagtccagtgtgaggtgcgtctggtggagtcgtgggaggacggcctgatccgaggtccggtcgggggtccctgacgctctcctgtgcagtccgtgtcggtcaccgtcagtccacacctanagtgagttcggccgcaggccnccggaaggggagggtcgtgggaggttggttccttacgtttattacgagtacgtaggtaggtaacgtactagtacgttccgactacggtaccgtccggttagggcgggggtacctatccgacctactaccgacaacggacaaactaaacgtacgtaaacgaacgtacgtacgtttaccgtttataaactaaaacgtacgtaaacgtcggtacgtacggaacggtaaccggacgtaacgtacggaacccgtaaccgggtacgtttaacggtaccgtttacggttaggacggagtaaacggaggtaccgggtaccgggtaacccgtaaacggttaaccgtacgtaccggattaacggtacggtacggttaccggacgggggtaaaccgaccgggacggttaacccgg

SEQ ID NO: 423812 - DNA, 686 bp, Homo sapiens
  misc_feature: GZ8MTXP02IRMT9.11.25.C03.1.454.CMB.2.raw
  modified_base (256)..(256): a, c, t, g, unknown or other
  modified_base (300)..(300): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtcgtggtggagtctggaggaggcctgatccagccgtgggggtccctgagactctcctgtgcngcctcgtgggttcaccgtcagtcacacctacatgagttggcccnccgaggctccgaggggagggcgtgggaggtgggttcttcgtttaatttacgagtcgtaggtggtaacgtactaattacttcccggacaacggtaccttcccgggttagggacgggggccgtaactttacccgaccactttcccaccgaagacgaaaccaacctactaaacgaaacaccgtctttgtttaccttacaaaatcgaaaactgacccttggaaacgtacggtacccgagtaacggaacccgtaccggggtccttaggttaactttaccgtggtacgaccggaagtacggacggttccgggggaacccctaacggttaaccttaaccgtacgacgtaattagggaccgttcggcggggaaccgaacggggtacccaccggg

SEQ ID NO: 423813 - DNA, 839 bp, Homo sapiens
  misc_feature: GZ8MTXP02GIZXB.11.25.C03.1.454.CMB.2.raw
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtgggaggaggcctggactccgacggcccggtcggggggttccctggacgtaccttcctcctgtcgcacgtccttcgttcgggttccacccgtcacgtccacctacctacagtggtaggttcgggtacccgccgacggccgtaccggagggggaacggggtcgtggggtaggttcggggtttacctttaccgtttttaagtttaacgaggtcgtaaggttcgggtaaacgttactaacgttaccgttccgacgtaacggtaccgttccgggtagggaccgggggtacccttaaacgttcccaacccgtacgttacccaccgaagtaaaccgaaacctaaaaccttaccgaaaaacgtaaacccgtacccgttaacttttcggttttaaccttaaactaaaacgttacgaaaccgtaaaccgtccgttaaggaaacggacgtaccgtaaacgttccgaaaccggtaccgggtaccgtttagttaaacgtttccgtgggtaccgaacggaaggtacggacggggttacccgggaaaccccgtaacgggtaaaccgttaaaccgtacggtacttaagggtaccggacggtttaccgggacggggaacccggtaacggggtaccccgtaacccggg

SEQ ID NO: 423814 - DNA, 595 bp, Homo sapiens
  misc_feature: GZ8MTXP02I9MYL.11.25.C03.1.454.CMB.2.raw
  modified_base (260)..(260): a, c, t, g, unknown or other
  modified_base (404)..(404): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaactcccctgctctggaattgaattgagagataaatatacttgttgtatcaanagaacgccaggccacgtcccctgtattggtcatctatacaagtatgtagaagcccggccctacgacggggtactcccgtagacgccgtattcctcgtcggcctccgaactcggtagggaacgcgacgccctactctagaccctntcgacggcgggacccagctagcggatgaggctagacttattagttcgtacgtagggcgttagggaactggacgagactacgtcgtacccgttagttcggttcgttacgggaacgtacgggaaccgtaacggtcccgtacggttcgttaggacgttaccgaccggacccgaaccgggtaccccaaaccccgg

SEQ ID NO: 423815 - DNA, 242 bp, Homo sapiens
  misc_feature: GZ8MTXP02JCD6S.11.25.C03.1.454.CMB.2.raw
  modified_base (241)..(242): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaagagtccagtgtgagtgcgtctggtggagtctggaggaggcctgatccagccgtgggggtccctgacgtnn

SEQ ID NO: 423816 - DNA, 667 bp, Homo sapiens
  misc_feature: GZ8MTXP02FMUI9.11.25.C03.1.454.CMB.2.raw
  modified_base (371)..(371): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtggggttcaccgtcagtcacacctacatggagttcgggccgccgaggctccgaggggaagggctggagtgggtcttctttattacagctagtggtagtacatacttccganagactcggtggcgggggccattccacctatctaccagacgaactaactactaaagaaccacgtcttcgtttacttacaaaatgaaacagtcctaggacgacgacccgaattacggaaccgtacgggtccgttagttaacttacgtggtcggacggtaaacgggacggaacggttccgggggaaccccctaaaccgggttaaacccgtttaaccgtacccggtacgttaaaccggtcggggtaaaccgttccgggggtaccgggggaaccgtaaaccgggggacccctaacccgggg

SEQ ID NO: 423817 - DNA, 869 bp, Homo sapiens
  misc_feature: GZ8MTXP02JXJAB.11.25.C03.1.454.CMB.2.raw
tcagcgagagataccacgaccggtgctcgatttagtagtgtagatttggggtttggggggagaggagcccagcactgggattccgaggtgtttccattcggtgatcagcactgaacacagaggactcaccatggtagttttggctgagtcgttgggttttccttgttgacttaagttttaaaaggagtccagtgtggaggtgcgtcgtggtggagtcgtgggaggaggcctgactccgaggtcccgggttcggggggtccctaggacgtacctcctccgtggtcgcacggtccgttcgttcgggttacacccgtcacggtccaacctacctacagttggtaggtttcgggcccgcgacgggtccgtaccggaagggggtaacggggtcgtggggtacggttcggggtttcctttaccggttttaactttaacgaggtcgtaaaggttgggtaacgttacgacttacgttccgacgtaacgtaccgtccggtgggaccgggggtcctaacgttcccaacgtactacccgaccgtaaacggaacgtaacctaaacccgtaacgtaaaaccgaaacgtacgttaccgtttcttttaaaccgttaacgtaaaaacgtacgtaaaaaccgtacggtacccgttaaagggacggaaccgggtaaccgtagggtaacccggaaccggttaaccggggttacccggtttaagttaaccggtttaaccggttcgggtaggtaccggaaaaggtaccggggaaccgggttacccggggaaccccgtaaacccggttaaacgtaacccgttaacggtacgttaaggtacgggtacggtccgggaaccgggggtacgaaaaccggggacccgtaccccggg

SEQ ID NO: 423818 - DNA, 756 bp, Homo sapiens
  misc_feature: GZ8MTXP02JSUPI.11.25.C03.1.454.CMB.2.raw
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgaggccgtggggggtccctggacgtactctcctgtgcagtccttcgtggtccaccgtcagtccacacctacagtggtaggttcgggtcccgccgaggccgtaccggaaggggacggggtctggggaggttcggttcctttacctttaattacaggtcgaaggttggtaatactatacttccgctaacgcgtccgggaggtacgggggccctagttcccacctacgttcctaccgaagacgtaaaccctaaacttacgtaaaacgaaccgtacgttcttacgtttacgttaaacaaagtacgaaaaccgtcggaccgttaggaacgtacgaccgtaaagttaccgaaaccgtacccggggttaccgtttagtttacgttaacggttcggtacggaacggtaaagggtacggaacgggtacccgggggtaaaccctaaacggttaaaccgttaaccgtacggtaccgttaaggtacggtaccgggtaccggtacgggggacccgtaaacgggggaccccttaacccgggg

SEQ ID NO: 423819 - DNA, 689 bp, Homo sapiens
  misc_feature: GZ8MTXP02GTS3M.11.25.C03.1.454.CMB.2.raw
  modified_base (253)..(253): a, c, t, g, unknown or other
  modified_base (277)..(277): a, c, t, g, unknown or other
  modified_base (380)..(380): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtgggggtccctgagctctcctgtgcngcctctggttcaccgtcagtcacncctacatgagttcggtccgccgaggcctccgaggggaagggctgggagtgggtcttaccgtttatttacgagtctaggttggtaagtacaacgttattcccgngacgactccggtgacgggggcctattcaccctatccgtaccaaggaacgaacctaaacttcgaaaacgaacccacgtctttacggtttcttaacaaaacttgaaacctacgccctaagacgacggcccgagtacgaaccgtaccgggtccggttagttaacgttacgtgtcggaccgtaaagggtacgaaggtcccgggggaacccctaaacgggttaacccgttaaacccgtacggaaccgttaacggtacggggtaaccgttcccggacgggggaacccgtaaaacgggggacccctaacccggggg

SEQ ID NO: 423820 - DNA, 796 bp, Homo sapiens
  misc_feature: GZ8MTXP02H4JID.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagcttgggttttccttgttgcttaattttaaaaggagtccagtgtgaggtgcgtgtggtggagtctgggaggaggcctgatccagccggtgggggtccctgagactctctgtgcagcctgtgggtcacgtcagtcacacacagtgaggtggtccgcaggctaccggaaggggaacggggctgggacggttcgggtcctttaccttttaagttaacgagtacaagggttggtaagtactaattacttccggacaggtaacccttcggggtagggacgggggtaccctaattacccgaacctaattcccgtaaccgaaggtaaacgaaaccctaaaaacttaccgtaaaaacgggaaaaccctcggttccgttttacggttttaacccttaaaaacaaaacgtacggaaaacctacggtaccgtaggaaacggaccgttacgaagtaccggaaccggtaccgggtcgttaagttaacgtttacgtcggggtacggaaggtaacgggtacggtacccggggtaccggggtaaaacccccgttaaacggtttaaaacccggttaaccgtaacggtccgttaacggggtaccggggtaacccggttccgggggtaaaccggggaaccccgggaaaccggggtaacccccgtaccggg

SEQ ID NO: 423821 - DNA, 813 bp, Homo sapiens
  misc_feature: GZ8MTXP02ICQPG.11.25.C03.1.454.CMB.2.raw
  modified_base (324)..(324): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtgggaggaggcctgactccgaggtccggtcggggggtccctggagtacctctcctgtgcacgcctcgtgggttccaccgtcagtcacctacctacagtggacggttcgggtcccnccgacgggcctaccgggaagggggggaacggggtcgtggggtaacgggttcggggtttaccctttaccgtttttaaacgtttaccgaggtcgtaaagggttggggttaaactacgtaaccttaaccgtttccccggactaaacggtacccgttaccggggtacggggtaccggggggtacccttaacgtttaccccgaaacccttacgttaccccgtaccgaaagaaacccgtaaaaccctaaaccttaaaccgtaaaaccggaaaccctaccggtttacttttacggttttaacccttaaaccgaaaattcgggaaaacctacgtcccgtaggacgtacgaccgtagacgaccggacgtccgtagttactcgtggacgacggaacgaggtaccgggaccggggtaccccaaacggttaaccgttacgtaccgagttaacggccggacggttacggggacgggggacccaaacggggtaccctccccgg

SEQ ID NO: 423822 - DNA, 560 bp, Homo sapiens
  misc_feature: GZ8MTXP02FF05O.11.25.C03.1.454.CMB.2.raw
  modified_base (238)..(238): a, c, t, g, unknown or other
  modified_base (245)..(245): a, c, t, g, unknown or other
  modified_base (257)..(257): a, c, t, g, unknown or other
  modified_base (261)..(261): a, c, t, g, unknown or other
  modified_base (296)..(296): a, c, t, g, unknown or other
  modified_base (329)..(329): a, c, t, g, unknown or other
  modified_base (349)..(349): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagcccaccctcagtgtccgtcgtcccaggacagacagccagaactcccctgctctggaattgaattgaganataaatntacttgtagtancaanagaagccaggccagtcccctgtattggtcatctanacaagatggtgaacgccggccctgacgggtacnccgtgacgtccgtacttccncgtcggcctacccaactccgacgggaaccgcacgtccactcacgacccagtaccgacggaccggaccaggctagtgagtgaggctagactattagtgtcgagggcgtggacagtcagccagtcgacccgttatcgtcgttacggacgtacgggaccgtaacggtccaccgtcgttacgacgtccgacgacccgaaacggcccaaaaccccg

SEQ ID NO: 423823 - DNA, 585 bp, Homo sapiens
  misc_feature: GZ8MTXP02G48O1.11.25.C03.1.454.CMB.2.raw
  modified_base (297)..(297): a, c, t, g, unknown or other
  modified_base (506)..(506): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggagtccaatgtgaggtgcgtctggtggagtctggaggaggcctgatccagccgtggggggtccctgagactctcctgtgcagcctcgtgggttcaccgtcagtcacacctcatgagttggccnccaggcctccgaggggagggctaggagtgggtctccgtttatttacgagcagtggtaagtacatacttccgctaagactccggtgacgggggtcccaattccaacccgattcctaccgagagaccaactactaaagaaccacgcttagtttccttacaaatacgtaacagcctagacgagccgagtagacgacggccgtagtattacgngtgacggagagagtcggggaccacgtaacgtacgtacgactaagtcggacgtcgacgggtaccgaacgggtaccaccgg

SEQ ID NO: 423824 - DNA, 547 bp, Homo sapiens
  misc_feature: GZ8MTXP02FNR1W.11.25.C03.1.454.CMB.2.raw
  modified_base (275)..(275): a, c, t, g, unknown or other
  modified_base (322)..(322): a, c, t, g, unknown or other
  modified_base (366)..(366): a, c, t, g, unknown or other
  modified_base (404)..(404): a, c, t, g, unknown or other
  modified_base (450)..(450): a, c, t, g, unknown or other
  modified_base (483)..(483): a, c, t, g, unknown or other
tcagcgagagataccacgaccggtgctcgatttagtagtgtagatttggggtttgggggggagaggagcccagcactgggattccgaggtgtttccattcggtgatcagcactgaacacagaggactcaccatggagttttggctgagctgggttttccttgttgctattttaaaaaggagtccagtgtgaggtgcgtctggtggagtctggaggagcctgatccagcctggggggtccctgagactctcctgtgcagcctctgggttcaccgtnagtcacacctacatgagttgggtccgccaggctccagggaaggggcngggagtggtctcctttattacagcagtggtagtacatattccgnagactccgtggacggggccattcaccatcgtaccaganacaactctaaagacacgctgtttctacaaatgaaacagccctaganagccgaatgaacacgggtcctgtattactggtncgagagatcggggcccacgaaaccgttcacgtcaatggacgtctggggccaaagggcccaacgg

SEQ ID NO: 423825 - DNA, 595 bp, Homo sapiens
  misc_feature: GZ8MTXP02JWGC5.11.25.C03.1.454.CMB.2.raw
  modified_base (366)..(366): a, c, t, g, unknown or other
  modified_base (387)..(387): a, c, t, g, unknown or other
  modified_base (390)..(390): a, c, t, g, unknown or other
  modified_base (395)..(395): a, c, t, g, unknown or other
  modified_base (406)..(406): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggtcaccgtcagtcacacctacatgagttcgggtcccgcaggctccgaggggaacggggctggagtggtctctttattacagcagtggtagtacatatccgnagctccgtgcggggcatcacntcncaganacatcaagacncgcttgtttctacaaatgaaacacgcctaggagacgaccgagtcgaacgacgggcgtagttacttacgtggtcgacgtaaggacggtacggtccgggggaaccctaacggtaaaccgtttaccgtaacgacttaaggtacgggtaccggttcggtacgggggacccaaacgggggtaccctacccgggg

SEQ ID NO: 423826 - DNA, 689 bp, Homo sapiens
  misc_feature: GZ8MTXP02GLF87.11.25.C03.1.454.CMB.2.raw
  modified_base (174)..(174): a, c, t, g, unknown or other
  modified_base (270)..(270): a, c, t, g, unknown or other
  modified_base (371)..(371): a, c, t, g, unknown or other
  modified_base (413)..(413): a, c, t, g, unknown or other
  modified_base (476)..(476): a, c, t, g, unknown or other
  modified_base (490)..(490): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctattttaaaaggngtccagtgtgaggtgcgtctggtggagtctggaggaggcctgatccagccgtggggggtccctgagactctcctgtgcagcctctgggtcaccgtnagtcacacctacatgagttcggccgccaggctcgaggggagggctggagtgggtcttccgtttaattacgagctaggtggtacgtactacttacttccganagtacctccggtgggacgggggtccgtactttccgaaccctnttaccgaccaaggaacgaacctaaacttcgtaaaagacctacggtcctttagtttaccttaanaaaagtcgtaaacnggtaccctgggaacgcgtaccggattacggaaccgtacccgggtcgtagttaacttacgtcggtggacgaaggacggtacgggtacgggggaccccctaaaggttaaaccggttaacccgtaccgtacgttaaacggtccggggtaaaccgttaccgggtacgggggaacccgtaaacgggggaacccccgtaacgggg

SEQ ID NO: 423827 - DNA, 733 bp, Homo sapiens
  misc_feature: GZ8MTXP02GOIVT.11.25.C03.1.454.CMB.2.raw
  modified_base (248)..(248): a, c, t, g, unknown or other
  modified_base (285)..(285): a, c, t, g, unknown or other
  modified_base (297)..(297): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggtagttttggctgagtctgggttttccttgttgcttaattttaaaaggagtccagtgtgaggtgcgtcgtggtggagtcgtgggaggaggcctgactccaggccggtggggggtcccngagtactctcgtgtcgcagcctcgtgggttcaccgtnacgtcacactanatgtacggttcggcccgacgacggtccgtaccggaagggggaacggggcgtaggggtacggttcgggtttcctttaccttttaacgtttacgacgtacgtaggttcggtaatactaaccgttacgttcccgacgaacggtaccccggtaggacggggccgtacttaccgaacctactacctcgaacgaacgtaaaccgtaacctaacgaaacgtaaaccgtctcgtttacgtttcttaacaaagtacggtaacacgtacccgtaggaggaacgtccggaaatccggaaacgtacccggtacggtacgtttaattggtacgtaggacggaaggacgggtacggtccggggaacccgtaacgggtaaccttacgcgttaaccgtagtcggggtaaccgtcggtaccggggaaccggacggtaacccgttacggtaccg

SEQ ID NO: 423828 - DNA, 766 bp, Homo sapiens
  misc_feature: GZ8MTXP02F99IX.11.25.C03.1.454.CMB.2.raw
  modified_base (173)..(173): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttcctgttgctatttaaaaggngtccagtgtgaggtgcgtcgtggtggagtcgtgggaggaggcctgactccacggccggtcggggggtcctgagactctcctgtgcacgtcctcgtggtcaccgtcagtcacactacatgagttcgggccgccgaggcctaccggagggggaacggggcgtaggggtaggttcggggttcctttaccttttaagtttacaggtacgtaggtggtaaagtactaacgttacttccgacgaacggtaccgtccggtagggacgggggcctaacgttaccaaccctacttcccgtaccgaaaggaaaccgtaaaccctaaaccttaaccgtaaaacgtaaacccgaccggtttaccttacggtttttaccttaaactaaaacgttacggaaaccgacggtccctaagggaaacggacggtacccgtaaggtaccgaacccggtacccggggtccgttaaggtttaacgttaccgtaggtacggacggtaaaggacggtacgggtaccgggaaccctaaacggtaaacgttaccgacgtaccgtaaggtcgggtaaccggtcgggtaccgggaaccggaacggggtacccgaaccggg

SEQ ID NO: 423829 - DNA, 675 bp, Homo sapiens
  misc_feature: GZ8MTXP02IKSG5.11.25.C03.1.454.CMB.2.raw
  modified_base (175)..(175): a, c, t, g, unknown or other
  modified_base (255)..(255): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggngtccagtgtgaggtgcgtgtggtggagtctggagggaggcctgatccaggccgtggggggtccctgagactctcctgtgnagcctctgggttcaccgtcagtcacacctacatgaggttcgggtaccgccgaggcctccggagggggaacgggctggggagtgggtcctcctttttatttacagtcaggttaggtatacactacgttccgactagtacgtcccggtgggacggggggccctaattacccaacccgtaacttccctacccaaggaacgaaaccaaaccttaactaaacgtaaacaccgttctttacggttttctaaccaaaagttgaaaaccaggcctaggaagacgaccgtagtcgaacgaccggtacgtgttaacttacgtgtacgcgtaagacgtaaggtccggggacccaaacggttaaaccgtaccgtaacgtacgttaagtcgggaacgttcggagggggacccgaaaggggtacccgtaaccgg

SEQ ID NO: 423830 - DNA, 759 bp, Homo sapiens
  misc_feature: GZ8MTXP02JSTAJ.11.25.C03.1.454.CMB.2.raw
  modified_base (259)..(259): a, c, t, g, unknown or other
  modified_base (412)..(412): a, c, t, g, unknown or other
  modified_base (620)..(620): a, c, t, g, unknown or other
tcagcgagagataccacgaccggtgctcgatttagtagtgtagatttggggtttgggggagaggagcccagcactgggattccgaggtgtttccattcggtgatcagcactgaacacagaggactcaccatggagttttggctgagctgggttttccttgttgcttaattttaaaaggagtccagtgtgaggtgcgtctggtggagtcgtggaggaggcctgactccgagccggtgggggtccctgacgtctctctgtncacgtcctgtcggttccaccgtcacgtcacacctacagtggtacggttcgggcccgccgaggtcctaccggagggggaacggggcgtagggaggttcgggttcctttacctttaattacaggtctaaggttggtaacgtacacttactcccgnacggtaccgtccggtagggaccgggggtcctaacttaccgaaccgtacttcccgaacgaacggtaaaccgaaccctaaaacgttaaccgaaaacggtaaacctaccgttcgtttacgtttaaccttaaacgaaaagttaccgaaaccgtaacggtccgtaggaacggacgacccgtagtacgaccgacgggtaccttagtaacttcgnggtacggacgaaggtacggacggtaacccgggggaccctaaaacgggttaccgttaacgtacgtacggttaaggtaccgggtaaaccggtccggggtaacgggggaaccccgtaaacgggggtaccccctaacccgggg

SEQ ID NO: 423831 - DNA, 680 bp, Homo sapiens
  misc_feature: GZ8MTXP02FETYA.11.25.C03.1.454.CMB.2.raw
  modified_base (176)..(176): a, c, t, g, unknown or other
  modified_base (272)..(272): a, c, t, g, unknown or other
  modified_base (340)..(340): a, c, t, g, unknown or other
  modified_base (364)..(364): a, c, t, g, unknown or other
  modified_base (418)..(418): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctattttaaaaggngtccagtgtgaggtgcgtctggtggagtctggaggaggcctgatccagccgtggggggtccctgagactctcctgtgcagcctctgggtcaccgtnagtcacacctacatgagttcggtccgccaggcctccaggggaaggggctggagtggtctctttatacngctagtggtagtacatacttccgnagactccggtaggcgggggtccaattcaccatcctcagacgacaaactctaaanaacacgtctagttttactacaaatagaaacaggtccctaggaacgagacccgtaagttaggaacccgtaacggggtccctttaagggttactttaaccgggtggtacgggaacggtaacggtaaacgggtaccggtacccgggggtaaacccctaaacgggttaaaacccgtttaaccggtaaccggtacgttaacggtaccggggtaaccgggttacgggaccgggggtaaacccggtaaaccgggggacccgtaaccggg

SEQ ID NO: 423832 - DNA, 597 bp, Homo sapiens
  misc_feature: GZ8MTXP02FHWY3.11.25.C03.1.454.CMB.2.raw
  modified_base (369)..(369): a, c, t, g, unknown or other
  modified_base (379)..(379): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtctggaggaggcctgatccagccgtggggggtccctgagactctcctgtgcagcctcgtgggttcaccgtcagtcacacctacatgagttgggtcccgccgaggctccgaggggaaggggctgggagtgggtcttcctttattacagcagtggtagtacatatccgnagactcgtgnggggccattcaccatctccagacgacaaactctaaagaacacgtctgtttctacaaatgaacagcctagacgagccgatcgaccgcggccgttagtacttacgtgtagcgaaggagacggtcgggggacccctaaacggtaaccgtttaacacggtacctaaggtccgggtaacggtccggtacgggggaacccgaaacgggggaccctaacccgggg

SEQ ID NO: 423833 - DNA, 797 bp, Homo sapiens
  misc_feature: GZ8MTXP02JK1NH.11.25.C03.1.454.CMB.2.raw
  modified_base (701)..(701): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggttttccttgttgcttaattttaaaaggagtccagtgtgaggtgcgtcgtggtggagtcgtggaggaggcctgactccagcccggtgggggtccctgacgtacctcctccgtgtcgcacgtccttcgtcggggttcctacccgtcacgtccaaccacctaacagtaggtacggtttcgggcccgccgacgggcctacccgggaagggggaacggggtccgtggggtaacggttcggggttacccttttaccctttttaagtttaccgaaggtccgtaaagggtttcggtaaacggttaacctaacgtttaccgtttaccccggacgtaaccggtacccggtttaccggggacggggtcccgggggtacctaactttaccccgacccttaacgtcccctaaccgaacgaacgtaaaccaaacttacgaaacgaacaccgttctttacgttaccttaaacgaaatacgaaccgaacgtccctaaggaacgtaccgaccgtacgtacgaccggacggttacgtagttacttacggtgacgacggtaagggtaccnggggtaacccgggtacccgaaaacggtacctttaaccgcggtacgtaaggtccgggtaccgtcgggggacgggacccgaaacggggtacctccggg

SEQ ID NO: 423834 - DNA, 794 bp, Homo sapiens
  misc_feature: GZ8MTXP02IDB6I.11.25.C03.1.454.CMB.2.raw
  modified_base (175)..(175): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggttttccttgttgctatttaaaaggntccagtgtgaggtgcgtctggtggagtctgggaggaggcctgatccagccgtggggggtccctgagactctcctgtgcagcctcgtggggttcaccgtcagtcaccacctacatgaggttcgggtcccgccaggctccgagggggaagggtctaggggagtggggtcttccttttagttactagctaaggtggtagtactattacttcccgcagtacgtcccggtagggcgggggcctaacttcccgaacctaattccctaccgaaacggacgtaacaaaaccttaaccgtaaacgaaaaccctaacgtcttttacggttttacctttaaccaaaaagttcgaaaaccgtagggtacccccttaagggaacggacggtacccccggaagtaccggaacccgaaaccgggtcccgttagtttaccgtttaaagtttccgggacgttaacggagggaacgtaccggggttacggggtaacccccccgaaaggtttaaaacccggttaaccgtttaaaccggcccgtttaaaagggtttcccgggggaaaagttttcccggggggtacgggggtaaaacccccgggaaaaccgggggtttacccccggtaaaaccccggggg

SEQ ID NO: 423835 - DNA, 745 bp, Homo sapiens
  misc_feature: GZ8MTXP02HEUUB.11.25.C03.1.454.CMB.2.raw
tcagcgagagataccacgaccggtgctcgatttagtagtgtagatttgggtttggggggagaggagcccagcactgggattccgaggtgtttccattcggtgatcagcactgaacacagaggactcaccatggagttttggctgagtctgggttttccttgttgcttaattttaaaaggagtccagtgtgaggtgcgtcgtggtggagtctgggaggaggcctgactccgagccggtcggggggtccctggacgactctcctgtcgcacgcctcgtcgggtcaccgtcagtcaccacctacagtggtaggttcggccgccgacggtccgtaccggaagggggaacggggtcgtaggggacggttcgggttcctttaccttttaagtttacgagtcgtaaggttaggtaacgtactaagttacttaccgcaacgtacgtaccgggtagggacgggggtcctaagttcctaaaccatccctacgaagaactaaacctaaacgtactaaaacggaaaccctacgtactttttacggtttaaccttaaacgaaaacgttacgaaaacgtaacgtaccgtaggaacgggacgaccggtaagtaccggaaccgtacgggacccggtttataacgtttacgttggtagacgggaacggtaacgaggtccccgggggtaaaccaaacgggtaaccgttaccgtagtacctaaggtacggaccgttcggaacgggaccgtacgggaaacctcgg

SEQ ID NO: 423836 - DNA, 565 bp, Homo sapiens
  misc_feature: GZ8MTXP02GSFKS.11.25.C03.1.454.CMB.2.raw
  modified_base (365)..(365): a, c, t, g, unknown or other
  modified_base (372)..(372): a, c, t, g, unknown or other
  modified_base (391)..(391): a, c, t, g, unknown or other
  modified_base (396)..(396): a, c, t, g, unknown or other
  modified_base (437)..(437): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtccagtgtgaggtgcgtctggtggagtccggaggaggcctgatccagccgtggggggtccctgagactctcctgtgcagcctctggggttcaccgtcagtcacacctacatgagttgggcccgccaggctccgaggggaaggggctggagtgggtctcctttatttacagcagtgtatacatactccgnagctcgngaggggccattcaccatcncaganacaactctaaagaacacgcttagtttcttacaaatgaaacngcctagagagccgatcgacgacggccgtagtacttctgtgcgagagagtcggggacccaacggtaaacgttacacgctaagtcgggacgtcggtacgggggacctaaacgggggacccacggtacccg

SEQ ID NO: 423837 - DNA, 569 bp, Homo sapiens
  misc_feature: GZ8MTXP02FSUJ8.11.25.C03.1.454.CMB.2.raw
  modified_base (241)..(241): a, c, t, g, unknown or other
  modified_base (304)..(304): a, c, t, g, unknown or other
  modified_base (370)..(370): a, c, t, g, unknown or other
  modified_base (401)..(401): a, c, t, g, unknown or other
  modified_base (407)..(407): a, c, t, g, unknown or other
  modified_base (431)..(431): a, c, t, g, unknown or other
  modified_base (451)..(451): a, c, t, g, unknown or other
  modified_base (500)..(500): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggagttttggctgagctgggttttccttgttgctaattttaaaaggagtccagtgtgaggtgcgtctggtggagtctggaggaggcctgatccagccgtggggggtcccngagactctcctgtgcagcctctgggtcaccgtcagtcaacacctacagtgagttcgggacccnccaggctccgaggggaaggggctggagtgggtctcctttattacagcagtgtagtacactatccgnacgacctcgtggcgggggcccatcaccatcnccaganacaaaccgtataaacgaacacgtntcgtttatacaaatgaaacngcctgagagcccgagtcgacccacgggcctagttactacgtgagcgaanggacgtcgggacccacgtaaaccgtcacgactaagtccggaagtccgtagggacctaacgggctaccgg

SEQ ID NO: 423838 - DNA, 904 bp, Homo sapiens
  misc_feature: GZ8MTXP02IE1SS.11.25.C03.1.454.CMB.2.raw
  modified_base (442)..(442): a, c, t, g, unknown or other
tcagcgagagataccacgaccggtgctcgatttagtagtgtagatttgggtttggggggagaggagcccagcactgggattccgaggtgtttccattcggtgatcagcactgaacacagaggactcaccatggtagttttggctgagcttgggttttccttgttgcttaattttaaaaggagtccagtgtgaggtgcgtcgtggtggagtcgtgggaggaggcctgatccagccgtgggggtccctgacgactctcctgtgcacgcctcgtcggttcaccgtcagtcacctaccacagtgtacggttcgggtcccgccgaggcctccggaagggggaacgggtcgtaggggtaggttcgggttactttacctttttaagtttacaggtcgtaaggttggttaaagtacctaacttacgttcccgactacggaccttccgggngggtacggggggtccctaactttcccgaaaccctaccttcccgtaccgaaaggtaaaccgtaaaccctaaaccgttaacgttaaaaccggaaaacccgtcccggtttacgttttcccggttttttaaccctttaaaccgtaaaaaacgttaccggaaaaccgttaccgtacccccggttaaggaaacggggtaacccgggacccccgtaaaggttaccggaaccccggttacccgggggtaacccgtttaggtttaacttttaaacccggggtcgggtaacggaacgggtaacggtaaaccgggtaacccggggtaccccgggggtaaaaccccttaaaccgggttaaaaccgtttaacccgttaacccggtaacggttaaccgggttaccgggtaaccggggttacccggggtaaccgggggtaaacccccggtaaaaccgggggtaccccgtaacccggg

SEQ ID NO: 423839 - DNA, 603 bp, Homo sapiens
  misc_feature: GZ8MTXP02I2M8W.11.25.C03.1.454.CMB.2.raw
  modified_base (338)..(338): a, c, t, g, unknown or other
  modified_base (360)..(360): a, c, t, g, unknown or other
  modified_base (550)..(550): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgctattttaaaaggagtcagtgtgaggtgcgtctggtggagtctggaggaggcctgatccagccgtgggggtccctgagactctcctgtgcagcctctgggttcaccgtcagtcacacctacatgagttgggtccgccaggctccgagggaagggctggagtggtctctttattacgngctagtgagtacatactccganagactccgtggacggggtcgaacttcaccctatcctacccgagaacgactaaactcgtaaacgaactaacgctttacgtttactactaaaatcgaaactagccctaagacgagtcccgagtacgaacacgggtcctgtaacttcgtgcgacgagagtacggcggggacccctaaaggtaacgtttacccnggtaacctgtcgggaacgttcggacggggacctaaaacggggccttaaccggg

SEQ ID NO: 423840 - DNA, 715 bp, Homo sapiens
  misc_feature: GZ8MTXP02G2HEQ.11.25.C03.1.454.CMB.2.raw
  modified_base (317)..(317): a, c, t, g, unknown or other
  modified_base (610)..(610): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttaattttaaaaggagtccagtgtgaggtgcgtcgtggtggagtcgtggaggaggcctgatccgagccgtcgggggtccctgagactctccgtgtgcacgtcctcgtcgggttccaccgtcagtcacctacctacagtggtacggttcgggtccnccgacggcctccggaagggggacggggctgggagtcggtcttcttcctttatttacagctagttggtataaccgtattacgttccgacacgaccgttcggtggggacggggacctacttcccaaccgtacgttaccctacccgaaggaaaccgtaaaccctaaacgttaccgtaaaagaacccgtacggttcctttaggtttttacctaaacaaaagtccgaaacgacgtcctagggacgtacgaccgaatccggaaactccgggtcttagttaacttcgtggaccgaacggngaacggtacggtaccgggggacccccaaaggttacccggtttaccacggttaacgttacggtcggggtaccgttcgggacccgggggacaaaaccggggtcccgg

SEQ ID NO: 423841 - DNA, 828 bp, Homo sapiens
  misc_feature: GZ8MTXP02GDDU0.11.25.C03.1.454.CMB.2.raw
  modified_base (177)..(177): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagctgggttttccttgttgcttaattttaaaaggngtccagtgtggaggtgcgtcgtggtggagtcgtgggaggaggcctgactccacggccgtgggggtccctgacgtacctctcctgtgcagtcctgtcggtccacgtcagtccacacctacataggtacggtcggtcccgcgtacggccgtaccggaagggggtaacggggtcgtggggtaaggttcggggttacctttaccgtttttaagtttacggacgtcggaaggttggtaacgtactaccgtacgtttaccggactaacggtaccgttaccggggtacgggaccgggggtacccttacggtttaacccaccggtaacctttacccgaaccggtaacgggtaaacccgaaaccgtttaaacccgttaaccgtaaaacgttaacccgacggtttaccccttaggtttttaacctaaaccggaaagttacccgaaaacgtacggtcgttaaacggacgttacggaaccccgttagaccggaacccgtacgggtacgtttcgttaaacgtcggtcgtaaggcggttaagggaaccgtacgggtaccgggggaaacccctaacggttaaaacccgttaccgtaacgtccgtttaaacgggtacggtacggaccggggttacggaacccgggaaccgttacccgtaaccccggg

SEQ ID NO: 423842 - DNA, 922 bp, Homo sapiens
  misc_feature: GZ8MTXP02G93E4.11.25.C03.1.454.CMB.2.raw
  modified_base (177)..(177): a, c, t, g, unknown or other
  modified_base (233)..(233): a, c, t, g, unknown or other
  modified_base (243)..(243): a, c, t, g, unknown or other
  modified_base (274)..(274): a, c, t, g, unknown or other
  modified_base (315)..(315): a, c, t, g, unknown or other
tcagcgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctnagtgtccgtgtcccaggacagacagcagaactccctgctctaggtattgaattganagtataaatntacgttgttagtataccaacgagaacgaccnggaccctacggtccccttaggtcttcggtacactttcttanactaaagtagtggtaaggaacggtcccggaccctagggacgggtaccttcccggagaccgacgttacgtttcctcggtgtacccctacccgtaaacgtccggtaacgggaaaccgtccgtaacccgtacccgtaccgtttaccgtacggaaacccttaacgtaccccggggtaaacgggaccccccgggggaaaccccgtttaagggggaaccttaacggggtacgggttaaacgggtacggggtttaaaaccgggggaccctttaaaggggtttaaaaccccctttttaaacggttttaagggtttttaaccggggacccggtttaaacggggggtggggttaaaccccgggggattaaaaccggcgggtaaaaaccggtccgtttaaaccccgggggtttacccgggtaacccccggtttttaaaggtttcccggtttaaaaccccggggtttacccgggggttaaaaccggggtcccgggggttaaaaacccccggttaagggggttcccccttaacccggggtttaaccggttaaggaacccgttaccccgggaaaccggttaaccccccgaaacccccggggtttaacccgaaaaccccccg

SEQ ID NO: 423843 - DNA, 739 bp, Homo sapiens
  misc_feature: GZ8MTXP02IG9ZV.11.25.C03.1.454.CMB.2.raw
  modified_base (283)..(283): a, c, t, g, unknown or other
  modified_base (318)..(318): a, c, t, g, unknown or other
tcagcgagagataccacgaccggtgctcgatttagtagtgtagatttgggtttggggagaggagcccagcactgggattccgaggtgtttccattcggtgatcagcactgaacacagaggactcaccatggagttttggctgagcttgggtttttccttgttgcttaattttaaaaggagtccagtgtgaggtgcgtcgtggtggagtctggaggaggcctgatccagccggtgggggtccctgacgactctcctgtgcagtcctcgtcgggttccaccgtcncgtccacctacctacatggtacggtggggtccccncgacggtcctccggaagggggacggggcgtgggtaggttcgggttccttccttttatttacgagtcgtagtaggtaatacgtaccttacttcccgacgtacgtaccgttcccggtagggaccgggggtacctaacgttaccaccctaacgtccctaaccgaacggaacgaaaaccaaacctactaaaacgaacctaaccgttcgtttacgttttactaaacgaaacgtacgaaaactacggtccgtagagggtaaccgccgtaagtaccgacggaccggtaccgttagttacttacgtcgtacggacgtaggacgtacgggtacccgggaccctaaaacggttaaccgttaactaaccggtcctaaagggtccgtaacggtccgggtaacggggacccgtaaaccgggggacctacccggg

SEQ ID NO: 423844 - DNA, 727 bp, Homo sapiens
  misc_feature: GZ8MTXP02F4GVX.11.25.C03.1.454.CMB.2.raw
  modified_base (170)..(170): a, c, t, g, unknown or other
  modified_base (272)..(272): a, c, t, g, unknown or other
  modified_base (284)..(284): a, c, t, g, unknown or other
tcagcgagagataccacgaccggtgctcgatttagtagtgtagatttgggtttgggggagaggagcccagcactgggattccgaggtgtttccattcggtgatcagcactgaacacagaggactcaccatggagttttggctgagctgggtttctgttgctatttaaagngtccagtgtgaggtgcgtgtggtggagtcgtggaggaggtcctgactccagccggtcggggggtcctgagactctcctgtgcagcctcgtgggttcaccgtnagtcacacctanatggtacgttcggccgacgacggccgtaccgagggggtaacgggtcgtagggacggttcggggttacttacccgtttttagttacacggtaccggtaggttagggtaacgttaactagttaccgttccgacgtacgtaccgttccgggtacgggacgggggccctaattaccgacctaagtccgacaaggaaacgtaccaaacgtttaaccaaaacgaaccgtaacggttaccttggtttactttaactaaaacgttaaactaaacgtaacgtacccgtacggaagtaacgacgtaacgtacgaaccgaccggtacggtacgttaccgttaacgttgtacggtacgtaacgtagacggttaccgggaccgtaaccggtaacgttaaaccgtacgtaccgtaagtacggacgttacggacgggacggaaccggacgtaacccgg

SEQ ID NO: 423845 - DNA, 422 bp, Homo sapiens
  misc_feature: GZ8MTXP01C8I5T.22.46.E02.1.454.CMB.2.raw
  modified_base (384)..(384): a, c, t, g, unknown or other
  modified_base (413)..(422): a, c, t, g, unknown or other
tcagacatacgcgtcacgaccggtgctcgatttagactcatctacagggaaagggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctagcctccacaaggcccatcggtcttcccctggcgccctgctccaggacgccacctccgagagcacagcggccccctggggctgccctggtcaaggctactcccacgcgtangtctgagcgggctgggcaaggcgcatagnnnnnnnnnn

SEQ ID NO: 423846 - DNA, 415 bp, Homo sapiens
  misc_feature: GZ8MTXP01BVNAX.22.46.E02.1.454.CMB.2.raw
  modified_base (408)..(415): a, c, t, g, unknown or other
tcagacatacgcgtcacgaccggtgctcgatttagactcatctacagggaaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacatggtcaccgtctcttagcctccacaaggtcccatcggtctcccctgcgcctgctccaggagcacctccgagagcacagcggccccctgggctgcctggtcaagggctactccacgcgtatgtctgagcgggctgggcaaggcgcatagnnnnnnnn

SEQ ID NO: 423847 - DNA, 421 bp, Homo sapiens
  misc_feature: GZ8MTXP01BI6HS.22.46.E02.1.454.CMB.2.raw
  modified_base (322)..(322): a, c, t, g, unknown or other
  modified_base (388)..(388): a, c, t, g, unknown or other
  modified_base (417)..(421): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctagcctcaccaaggcccatcggtcttcccctggcgccctgctccaggngcacctccgagagcacagccggccccctggggctgccctggtccaagggctacttcccacgcgtanggtctgagcgggctggcaaggcgcatagnnnnn

SEQ ID NO: 423848 - DNA, 712 bp, Homo sapiens
  misc_feature: GZ8MTXP01EVHSH.22.46.E02.1.454.CMB.2.raw
  modified_base (311)..(311): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagccaccaccaggaccaaacgccccccaacttctttaattttggtntacaactaacccgcccctcgacggggtccctgactccgtccttccccgtcccggtctacccgtaagtccgtacgggaccaaccgaccggtcccctccctcggaaccctactccttcgtcgggtacctccgaacgggtcctaggaaccggtagttacggggtaggggtttacgttacgtttttacgtcgtacgttggtccgttactaaagttagttcgaccgaacgggtaacctaaacgtttaaattaaacgttaggttcgggttaccggtttacgggggaaccgggtaaacgggaaccgtaaaacgggttcgtaaccccggttaccgttacgggttcccaacggtaacccccgaaaggtcccgtcccggtcccccgttcgggtaaccttaaccgtttcccg

SEQ ID NO: 423849 - DNA, 535 bp, Homo sapiens
  misc_feature: GZ8MTXP01AUAXP.22.46.E02.1.454.CMB.2.raw
  modified_base (440)..(440): a, c, t, g, unknown or other
  modified_base (529)..(529): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagccaccacccaggacaaacgccccccaatctttaattttgtgtacaaactaacccgcccctcgacgggggtcccctgactcgccttccctccggctccaagtctaggaccaacgaccggccctccctcgacccatctctggactccgaggctgacgagtgaggtgtactttacngctgctcatatgcagcaatatatagtgtcgtcggaacggaggaccaaagttgaccgtcagttcacgccaggcctcgccccttcggtccncgtccg

SEQ ID NO: 423850 - DNA, 588 bp, Homo sapiens
  misc_feature: GZ8MTXP01D3WPB.22.46.E02.1.454.CMB.2.raw
  modified_base (301)..(301): a, c, t, g, unknown or other
  modified_base (434)..(434): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagccctcctcactcagggcacaggatcctgggctcagtctgccctgactcagcctcgctcagtgtccgggtctccgtggacagtccgtcaccatctcctgcactgggaccagcagtgatgttggtgcttataactatgtctctggtacagcaccaccagcaacgcccccatcttaattttggntacaactaaccgcccctgacgggtccctgactcgtcttccctccggctaccaacgtctacggccaaccgccggccctccctcgacctatctactcggactccgagctggacgtagtcggaggtgtactttacngtctgcttcatatgcaggtacctaattaataattagtcggttacgttcgggaacgggtaacggaaccgtaaacgttcggaaccgttcgttaagggttccaaccggcccgaaaggtcccgtccggtcccccgttcggtccttaaccgtttccccg

SEQ ID NO: 423851 - DNA, 408 bp, Homo sapiens
  misc_feature: GZ8MTXP01CDAHO.22.46.E02.1.454.CMB.2.raw
  modified_base (301)..(301): a, c, t, g, unknown or other
  modified_base (304)..(304): a, c, t, g, unknown or other
  modified_base (314)..(314): a, c, t, g, unknown or other
  modified_base (324)..(324): a, c, t, g, unknown or other
  modified_base (329)..(329): a, c, t, g, unknown or other
  modified_base (401)..(408): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaagtggtcacgtctcttagcctcacaggccatcgtctccccngcncctgctcagncacctcgagngcacngcgccccctgggctgccctggtacaaggctactccacgcgtatgtctgagcgggctggcaaggcgacatagnnnnnnnn

SEQ ID NO: 423852 - DNA, 533 bp, Homo sapiens
  misc_feature: GZ8MTXP01BHH2W.22.46.E02.1.454.CMB.2.raw
  modified_base (301)..(301): a, c, t, g, unknown or other
  modified_base (315)..(315): a, c, t, g, unknown or other
  modified_base (323)..(323): a, c, t, g, unknown or other
  modified_base (334)..(334): a, c, t, g, unknown or other
  modified_base (410)..(410): a, c, t, g, unknown or other
  modified_base (527)..(527): a, c, t, g, unknown or other
tcagacatacgcgtcacgaccggtgctcgatttagactcatctacagggaaagggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagcccccaatccttaatttggntcaataccgccctnagggtccngatcgcttccnccggctccagtctgcaacacggcctccctgaccatctctggactccaggctgacgtagtgagggtgtactttacgngtcgtgcgtctatatgctaggactaactataagtgttggtctcgggaacgggaacggacgtaaacggttcgtaccgtcgttaggttcaccgcccgaggcctccgccccgttcgtccnccgtcg

SEQ ID NO: 423853 - DNA, 412 bp, Homo sapiens
  misc_feature: GZ8MTXP01ECBNQ.22.46.E02.1.454.CMB.2.raw
  modified_base (408)..(412): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccacaaggcccatcggtctcccctggcgccctgctccaggagcacctccgagagcacagcgccccctgggctgcctggtcaaggctacttccacgcgtatgtctgagcgggctggcaaggcgcatagnnnnn

SEQ ID NO: 423854 - DNA, 424 bp, Homo sapiens
  misc_feature: GZ8MTXP01EE6TM.22.46.E02.1.454.CMB.2.raw
  modified_base (328)..(328): a, c, t, g, unknown or other
  modified_base (412)..(412): a, c, t, g, unknown or other
  modified_base (415)..(424): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaacaagggcccatcggtcttccccctggcgcccctgctccaggancacctccgagagcacagcggccccctggggctgccctggtcaaggctactccagcgtatgctgagcgggctggcgaagcgcganagnnnnnnnnnn

SEQ ID NO: 423855 - DNA, 598 bp, Homo sapiens
  misc_feature: GZ8MTXP01BL9KW.22.46.E02.1.454.CMB.2.raw
  modified_base (448)..(448): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatcctcctgcactgggaccagcagtgatgttggtgcttataactatgtctcctggtaccagcaccaccaggccaaacgcccccaattctttaattttggtgtacaacttaaccgcccctcgacggggtccctgactcgcttccctccggctccagtctcggcaacgaccggccctccctcgacctactctccgtacggacctccgagggcctaggacgtagtggagggttgtactttacgngacttgcgtctatatcgacaggactaactaataatagttcggtcgttcgggaacgggtaacgggaaccgtaaagttccggaccgtacgttacgggttaccacggaacccgaaggcccgtccggcccccgttcggtcccttaacgttcccg

SEQ ID NO: 423856 - DNA, 451 bp, Homo sapiens
  misc_feature: GZ8MTXP01EGVVT.22.46.E02.1.454.CMB.2.raw
  modified_base (305)..(305): a, c, t, g, unknown or other
  modified_base (308)..(308): a, c, t, g, unknown or other
  modified_base (334)..(334): a, c, t, g, unknown or other
  modified_base (442)..(451): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcacgtctctagcctccaccaggcccatccggtcttccccngcnccctgctccaggcgcaccctccgagngcacacggccggccccctggggctcggcccgtggtaaccaagggtaacctaccttcccgacgtcgtatcggtctggacggtcgggctgggacaagggccgagaagtgnnnnnnnnnn

SEQ ID NO: 423857 - DNA, 578 bp, Homo sapiens
  misc_feature: GZ8MTXP01B5OIP.22.46.E02.1.454.CMB.2.raw
  modified_base (216)..(216): a, c, t, g, unknown or other
  modified_base (232)..(232): a, c, t, g, unknown or other
  modified_base (308)..(308): a, c, t, g, unknown or other
  modified_base (379)..(379): a, c, t, g, unknown or other
  modified_base (412)..(412): a, c, t, g, unknown or other
tcagacatacgcgtcacgaccggtgctcgatttagactcatctacagggaaaggggggggtctcaggaggcagcactctcgggacgtcaccaccatggcctgggctctgctcctcctcagcctcctcactcagggcacagggtcctgggcccagtctgccctgacccagcctgcctccgtgtctggatcatctggacagtcgatcagctatttccngcacgtgggaaccaangtgactagttgggtcttttgactctgtctctggtaccaacaacaccacgaccaaaccccccatcatcattatggtncactcgtccgccctcgacggggtccctgactcgcttcctctggctccagtcctggcaacaccggccctccncgaccatcctcgtgggcctccgaggctgaaagngtgaggctgtattacttagtcggtctgtcctcgtagtttcgcgacggtccgtcctacgtacgtttggggtcgttcggggcggacgggtaccaaaggtccgtcggttacccgttccgttacgggccacggcccgaacgggccttcccggcccccgttcggtaacccc

SEQ ID NO: 423858 - DNA, 676 bp, Homo sapiens
  misc_feature: GZ8MTXP01B4F52.22.46.E02.1.454.CMB.2.raw
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggaccaaacgcccccaactctttaattttggtgtacaactacccgccctcgacggggtccctgactcgcttcctccggctccaagtctacggacaaccgaccggtccctaccctaaccactcctcgtcgggtcctccgtaggtttggacggtacgtagttacttactttattactgtactacgtttacctttaaaagttacgggggtcctaccgtacttccgttcggtttcgggtttcgggcgggtacgggcctaaccggtaaacggtccggtaacccggttcccgtaccgggttccgaccggaccccgaaacgggtcccttcccggttccccccgttccgggttccctacccttccgttcccggtttcccccacccccgttccccttcccgtaacccgg

SEQ ID NO: 423859 - DNA, 528 bp, Homo sapiens
  misc_feature: GZ8MTXP01DBG7R.22.46.E02.1.454.CMB.2.raw
  modified_base (249)..(249): a, c, t, g, unknown or other
  modified_base (256)..(256): a, c, t, g, unknown or other
  modified_base (468)..(468): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtcccgggtctcctggacagtccgtcaccatctcctgcactgggaccagcagtgatgttggtgtatactntgtctcngtaccaacaacacccaggcaaacgccccaaatcatgatttatgaggtcactaacgcggccctcgacgggtccctgactccgcttctcgtggcctaccaagtcgtggccaaacaccggccctccctgacccgtctcgtcgggcctccgaggcctaggaggtatcgaggctgtatttatacgtgcagctcatgtggaggcagcgataagttggngttcgggcggaggaccagcgttcgaccgtcgacgtcacgcccgagtccgttcgtcccccg

SEQ ID NO: 423860 - DNA, 752 bp, Homo sapiens
  misc_feature: GZ8MTXP01CCBNP.22.46.E02.1.454.CMB.2.raw
tcagacatacgcgtcacgaccggtgctcgatttagactcatctacaggggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatcctctgcacgtgggaccagcagtgatggttgtgcttatactatgtctcctggtaccagaccaccacccgacggaccaaaaccgaccccccctaaactttactttaaacgtttttcggtacgttaccaaacttaacccccgcccccttacggtaccgggggttcccctagtaccgttccgtacctttccccgtccccgggtctacccgtaacgtccgtaacgggacccctaacgacccgggtcccttcccccgtacgaaccctacttaccgtccgttacggaacccttaccgaacggcgttacggaccgtaagttacgggtaacgggttcgttaaccttttacgtcgttaccgttagtccgttaactattaacgtcggaccaacgggtacctaaagtttacctaaagttacgttacggttaccgttacggggaaccgggtaacgggaaaccgtaaacggttccggtaaacccgtcgttacggttccgacggtcccgtaaacggccgttacccggccccgttccggtccgttaaccttcccgg

SEQ ID NO: 423861 - DNA, 603 bp, Homo sapiens
  misc_feature: GZ8MTXP01DFW8O.22.46.E02.1.454.CMB.2.raw
  modified_base (239)..(239): a, c, t, g, unknown or other
  modified_base (296)..(296): a, c, t, g, unknown or other
  modified_base (434)..(434): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcacatctctgcactgggaccagcagtgatgttgtgnttatactatgtctctggtacagcaccaccaggcaaacgcccccaatcttaattttgngtacaactaaccgccctacgacgggtccctgactcgcttccctccggctccaagtctacggacaaccgaccggtccctccctagaccatctcgtacgactccgaggtctgacgtagtggtagggttcgtactttacgngtctgtctactatagtcgacgaacggactaaacttaataaagttagttcggtcgttcggggaacgggtaacgggaaccgtaaaggttcggtaacccgttcgttaacgggcaccggtaacccgaaacgggtccttaccggccccgttacgggtcccttaacgtttccccg

SEQ ID NO: 423862 - DNA, 414 bp, Homo sapiens
  misc_feature: GZ8MTXP01CTHEO.22.46.E02.1.454.CMB.2.raw
  modified_base (409)..(409): a, c, t, g, unknown or other
  modified_base (411)..(414): a, c, t, g, unknown or other
tcagacatacgcgtcacgaccggtgctcgatttagactcatctacagggaaaggggctggagtggatttcatatattaacgatggagggaggacgaaaaggtacgcaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccacaaggcccatcggtctcccctgcgccctgctccagagcacctccgagagcacagcggccccctggggctgccctggtcaagggctacgttcccaaagcgtaatgtctgagcgggctgcgagcgcanannnn

SEQ ID NO: 423863 - DNA, 576 bp, Homo sapiens
  misc_feature: GZ8MTXP01A5EZM.22.46.E02.1.454.CMB.2.raw
  modified_base (310)..(310): a, c, t, g, unknown or other
  modified_base (457)..(457): a, c, t, g, unknown or other
  modified_base (568)..(568): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatggttggtgcttataactatgtctcctggtaccagccaccacccaggaccaaacgccccccaactctttaattttggntacaaactaacccgcccctcgacggggtccctgactcgtcttcccctccggctccgaagtctacggacaaccgaccggccctccctcgacctactcctcgtcggtacctccgaggtctagacgtagtggtagggttctactttacgngtctcgctacatactgacaggactaatataagtagtggtcgttcgggaacggtaaggactaaagttcgtaccgtcgttacggttcacgccagcctccgccccgttcgtccncgttcccg

SEQ ID NO: 423864 - DNA, 615 bp, Homo sapiens
  misc_feature: GZ8MTXP01DL3UC.22.46.E02.1.454.CMB.2.raw
tcagacatacgcgtcacgaccggtgctcgatttagactcatctacagggaaagggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctggtaccaacaacacccagaccaaaccccccaatcatcattatgtgtcactcgtcggccctcaggagtctctcatcgccttctcaggcctccaaaagtctggctaaacgaccggccctacccctaacatctctgggcctcctagtttgaggacgagttctacttattactgtactagtttactttaaaattggcgtacctacttccgttcggtttcgggttttacggcggtaggtccgaccggtaaaggtcggtaacccgttccgttccggggttaccacggtccccgaaagggttccttccggccccccttacgggtcctaccgttccttcggtttcccccgaacccgtttccccg

SEQ ID NO: 423865 - DNA, 427 bp, Homo sapiens
  misc_feature: GZ8MTXP01C73SC.22.46.E02.1.454.CMB.2.raw
  modified_base (308)..(308): a, c, t, g, unknown or other
  modified_base (313)..(313): a, c, t, g, unknown or other
  modified_base (345)..(345): a, c, t, g, unknown or other
  modified_base (402)..(402): a, c, t, g, unknown or other
  modified_base (418)..(427): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggcccatcggtcttcccccnggccnccctgctccaggagccacctccgagacgcacngcggcccccctggggctgcctggtacaaggctactccacgcgtatgtctgagcgggntggcaaggcgcatagnnnnnnnnnn

SEQ ID NO: 423866 - DNA, 434 bp, Homo sapiens
  misc_feature: GZ8MTXP01DXY9P.22.46.E02.1.454.CMB.2.raw
  modified_base (307)..(307): a, c, t, g, unknown or other
  modified_base (312)..(312): a, c, t, g, unknown or other
  modified_base (328)..(328): a, c, t, g, unknown or other
  modified_base (342)..(342): a, c, t, g, unknown or other
  modified_base (423)..(434): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctcttagcctccaccaaggcccatccgtcttccccnggccnccctgctccgaggacncaccctccgagacncacagccgcccccgtgggctgcctggtacaaggctactccacgcgtatgtctgacgcgggctgggcaaggcgtacaagtgnnnnnnnnnnnn

SEQ ID NO: 423867 - DNA, 541 bp, Homo sapiens
  misc_feature: GZ8MTXP01BUKZT.22.46.E02.1.454.CMB.2.raw
  modified_base (252)..(252): a, c, t, g, unknown or other
  modified_base (382)..(382): a, c, t, g, unknown or other
  modified_base (429)..(429): a, c, t, g, unknown or other
  modified_base (439)..(439): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactntgtctctggtacagccaccaccaggacaacgcccccaatctttatttgcgtacaactaccgccctcgtacgggtcctgactcgtccttcctccggtctaccaagtctacggaccaacgacgtccctcccncgacctactctctcgactcgagctagacgagtggagttgtactttcngctgctcatntgcagcaactatatgtgtcgtcggcggtacgacgtaagttcgaccgtcgttacggttccacgtcccaggtcctccggtccccttcggtccttaacgttcccg

SEQ ID NO: 423868 - DNA, 720 bp, Homo sapiens
  misc_feature: GZ8MTXP01EXHHP.22.46.E02.1.454.CMB.2.raw
  modified_base (218)..(218): a, c, t, g, unknown or other
  modified_base (228)..(228): a, c, t, g, unknown or other
  modified_base (259)..(259): a, c, t, g, unknown or other
  modified_base (299)..(299): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacagtcagtcacatcctcctanactggaaccngcagtgatggttggtgttatactatgtctcngtacacagcaccgagcaacgccccagactcatctatttangctagtacaagtacgccggccctacggacggggtccccctggactccgtcttcgtcgtcggctacctaagtccgtcggacctaaccgccggtccccttcccgtagaccctagtccgtcgtcgggtaccctccgaacgggtcctaggaaacgtacgttacgggaacgggtcctttaaggttaaattttaaaccgttaccgttcggtacccttacggttccgttaccttaagttttccggaacccggtacggggtaccccgtcccgtttaaacggttaccggggttttcggggggttccgggttacccggggggaaccgggggttaaacggggttaaccccgaaacgggtcccggttacccgggtaaccccggtttccggtaaccggggttaccgaacccgggttaaccccgtaaacccgggg

SEQ ID NO: 423869 - DNA, 640 bp, Homo sapiens
  misc_feature: GZ8MTXP01AH55J.22.46.E02.1.454.CMB.2.raw
  modified_base (253)..(253): a, c, t, g, unknown or other
  modified_base (631)..(631): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccctcaccatcctcctgccactgggaccagcagtgatgtgtgcttataactatntctcctggtaccagccacccacccgaggaccaaaccgccccccaattctttaagttttcggctacaactaccccgcccctacgacggggtccctgactcgccttcccgtccggctaccgaacgtccgtaacggccaaccgaccgggtccctccccgtacgaccctacttcctcgtcggtacctccgaggcctaggaccgagtagggtacgggttacttacgttttaccgtgtccgttggccttacagttagacggacctacggactaaacgttaataagttacgtcggttacgttcggggaacggtaacgggacctaaacggttcgaacccgttcgttacgttccgacgtcccgaagccgtaccgtcccgttcggtcncccgttccg

SEQ ID NO: 423870 - DNA, 652 bp, Homo sapiens
  misc_feature: GZ8MTXP01ETQFI.22.46.E02.1.454.CMB.2.raw
  modified_base (306)..(306): a, c, t, g, unknown or other
  modified_base (322)..(322): a, c, t, g, unknown or other
  modified_base (449)..(449): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccacggaccaaaccccccatcatcatttatggtntcactcgtcggccctnaggagtctctcatcccgcttctcaggcctaccaagtctgggaccaaaccaccggtccctaccctaaccacttcctcgtcgggcctcctagtttcggaacggacgtaacgtccttacttacttacgtntacgttagggtttaccctttaaagttacgggtcctacctaccgttccgttcggtttcggttttcgggccggtaaggcccgtaaccggaaacggttcggaaccccggttccgttaccgggttcgaaccggttccccgaaacgggttcccgttccggccccccgttcgggtccctaccttccttccggtttccccgtaacccccg

SEQ ID NO: 423871 - DNA, 640 bp, Homo sapiens
  misc_feature: GZ8MTXP01C4UDS.22.46.E02.1.454.CMB.2.raw
  modified_base (231)..(231): a, c, t, g, unknown or other
  modified_base (238)..(238): a, c, t, g, unknown or other
  modified_base (252)..(252): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcacatctcctgcactgggaccagcagtnatgtggnctataactatgtcnctggtaccagcaccaccagctaaacgccccaaattctaatttggatacaactaacccgccctacgacgggtcctgactcgtctttcccgccggactaccgaaagtcctaacggacaaccgaccggtcccttacccctagaccctaactctccttacgggacctacccgaacgggtcgtacgtaacgtaacgtacggtaggttacgttacgttacgttacgtacgtcgtacgtactaagtacgtacgacgtaacgtaacgtaaacgttaaataaagttaagtacggttacggtacggtaacgggtaacggaaacgtaaacggttacgtaccgtacgttacgttacgacgaaccgacgtccgtccgtcccgttaccgtccgttccgtccg

SEQ ID NO: 423872 - DNA, 417 bp, Homo sapiens
  misc_feature: GZ8MTXP01BSITV.22.46.E02.1.454.CMB.2.raw
  modified_base (309)..(309): a, c, t, g, unknown or other
  modified_base (411)..(417): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctagcctcaccaaggcccatcggtcttcccctggcnccctgctccaggacgcacctcgagagcacagcggccccctgggctgcctggtacaaggctactccagctatgtctgagcgggctgggcaagggcgacatagnnnnnnn

SEQ ID NO: 423873 - DNA, 796 bp, Homo sapiens
  misc_feature: GZ8MTXP01EL5Y6.22.46.E02.1.454.CMB.2.raw
tcagacatacgcgtcacgaccggtgctcgatttagactcatctacagggaaaggggggggtctcaggaggcagcactctcgggacgtctccaccatggcctgggctctgctcctcctcagccctcctcactcagggcacaggatcctgggctcagtctgccctgactcagcctcgctcagtcgtccgggtctccgtggacagtccgtcaccatcctcctgcacgtgggaccagcagtgattggttggtgcttataactatgtctccgtggtaccagccaccacccgaggaccaaaccgccccccctaaattacttttaaagtttttcggtacgtacctaaacctaaccccgcccccttcggtaaccgggggttccccttgaacgttccgtcctttaccccgtccccgggtacctacccgtaaaggttcccgtaaccgggaccctaacccggtacccgggtccccttaccccgtacgaaccccttacgtccgttacccgtacgggtaccttacccgagggtaccttacgggaaaccgttaaggttacgggtaagggggttactttaaccgtttttaccgcggttacgttcgtacgttaacgtagttacgtacgaacgtaacgtaaccttaaacgttaagttaacgttggttaccgggttaccgggttacggggaaccgggtaaacgggttaaaccgtaaacggttaccggtaacccggttaccgttacggttaccgaccggtaacccggtacggtcccgttcccggccccgttaccggtaacccgttcccgttcccg

SEQ ID NO: 423874 - DNA, 683 bp, Homo sapiens
  misc_feature: GZ8MTXP01EAXKV.22.46.E02.1.454.CMB.2.raw
  modified_base (199)..(199): a, c, t, g, unknown or other
  modified_base (240)..(240): a, c, t, g, unknown or other
  modified_base (242)..(242): a, c, t, g, unknown or other
  modified_base (250)..(250): a, c, t, g, unknown or other
  modified_base (500)..(500): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctcctggacngtccgtcaccatctctgcacgtggaccagcagtgatgttgngnttatactntgtctctgtacagaccaccacccaggaccaaacgacccccctaattctttaagttttcggtacgtacctaactaaccccgccccttacggtacggggtcccctgactccggtccttccccgtccggactcccgaaacgttccgtaacgggaccctaaccgacccgggtccctaccccgtacgaaccctctccgttacgtcgtacctccgaggcgtcgaacgtagtcggtaaggggttcttacgtttaccnggtcttcgcgttactagttactgacgtaacgactaaacttagtaattggttcggttccggttcgggaacgggtaacggttaaccgtaaacggttcggtaaccggttcgttacggggttacaccgggtaaccccgtaaagggtcccttacccggccccggttacggtccttaaccgtttccccg

SEQ ID NO: 423875 - DNA, 447 bp, Homo sapiens
  misc_feature: GZ8MTXP01D2DG8.22.46.E02.1.454.CMB.2.raw
  modified_base (219)..(219): a, c, t, g, unknown or other
  modified_base (314)..(314): a, c, t, g, unknown or other
  modified_base (330)..(330): a, c, t, g, unknown or other
  modified_base (432)..(432): a, c, t, g, unknown or other
  modified_base (434)..(440): a, c, t, g, unknown or other
  modified_base (442)..(447): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgaganattggcaagcctgggcctttgatgtctggggccctgggacagtggtcacgtctctagcctccacgaaggcccagtccggtcctcccccgtggccncccctgcctccaggcncaccctcgagacgcacagccggcccccgtggctcgccctggaaccaagggcctacgtccacgtcgtatcgtctggacgcgggctgggcaagggcgactaagngnnnnnnngnnnnnn

SEQ ID NO: 423876 - DNA, 699 bp, Homo sapiens
  misc_feature: GZ8MTXP01AOF8M.22.46.E02.1.454.CMB.2.raw
  modified_base (243)..(243): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtggacagtccgtcaccatcctcctgcactgggaccagcagtgatgttggngcttatactatgtctctggtaccagccaccaccaggaccaaacgccccctaatctttaattttggctacaactacccgcccctcgacggggtccctgactcgtccttcccgtaccggctaccgaacgtcctaacgggaccaaccgaccgggtcccctcccgtacgaccctactctaccgtcggacctccgaggtcctaggacgtaagtgggtacggggttacttacctttacgtggtcttcggtcttactagttacgtcggacaacgggtaccctaaaactttaagtaaacgttaaggttccgggttaccgttacggggaaccggggtaaacggggttaaacccgtaaaacgggttccgggtaaaccccgttacggttaacgggttcccgaaccggaaccccggtaaggtcccgttacccggtcccccgttcgggtaacccttaaccgtttccccg

SEQ ID NO: 423877 - DNA, 460 bp, Homo sapiens
  misc_feature: GZ8MTXP01A5TK8.22.46.E02.1.454.CMB.2.raw
  modified_base (309)..(309): a, c, t, g, unknown or other
  modified_base (324)..(324): a, c, t, g, unknown or other
  modified_base (338)..(338): a, c, t, g, unknown or other
  modified_base (356)..(356): a, c, t, g, unknown or other
  modified_base (446)..(460): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgagacacggctgtctattactgtacgagagattggcaagcctgggtcctttgatgtcgtggggccctgggacaagtggtcacgtctcttagcctccacaacggccatccggtcctccccgngccgcctgctcagcnccacctccgagacncacgcgccggccccccgngggctgcccgtggtacaaggtcctaccgttccgaacggtcgtagtcggtcctggacgtcgggcgtcgggacgaaacgggcgacgagtagnnnnnnnnnnnnnnn

SEQ ID NO: 423878 - DNA, 410 bp, Homo sapiens
  misc_feature: GZ8MTXP01EJ5N7.22.46.E02.1.454.CMB.2.raw
  modified_base (302)..(302): a, c, t, g, unknown or other
  modified_base (305)..(305): a, c, t, g, unknown or other
  modified_base (316)..(316): a, c, t, g, unknown or other
  modified_base (326)..(326): a, c, t, g, unknown or other
  modified_base (330)..(330): a, c, t, g, unknown or other
  modified_base (383)..(383): a, c, t, g, unknown or other
  modified_base (399)..(410): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctcacaaggccatcggtctccccngcncctgctcagcncacctcgagncacngccgcccctgggctgcctggtacaaggctactccacgctatgtctgagcgggntggcaaggcgcatagnnnnnnnnnnnn

SEQ ID NO: 423879 - DNA, 703 bp, Homo sapiens
  misc_feature: GZ8MTXP01AWMA7.22.46.E02.1.454.CMB.2.raw
  modified_base (246)..(246): a, c, t, g, unknown or other
  modified_base (402)..(402): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtccgtcaccatctcctgcacgtgggaccagcagtgatggttggtncttataactatgtctctcggtaccagccacccacccaggaccaaaaccgcccccctaacttctttaaagttttggtcgtacaactaacccgccctcgacgggtcctgactcgtcttcccgccggctcgaagtcgtacggacaaccgcggccctccncgaccactctacgtcgtactcgtagttcggaggtacgtacgttacttacttacgtactcgtacttaacgtttaccgtttaaagttacgggacgtaccctacgtttaccggttcgggtttcggggttttaccgggacgggtacgggtaccgtaaccgggtacgtccggtaaccccggttccgttaccggggtcccttaagggacccccgtaacgggttccccgttcccggttcccccccgttcgggtcccttaacccggttcccgttccccggttcccccgtccccgttcccgtaaccccgg

SEQ ID NO: 423880 - DNA, 610 bp, Homo sapiens
  misc_feature: GZ8MTXP01EKYA0.22.46.E02.1.454.CMB.2.raw
  modified_base (242)..(243): a, c, t, g, unknown or other
  modified_base (250)..(250): a, c, t, g, unknown or other
  modified_base (252)..(252): a, c, t, g, unknown or other
  modified_base (257)..(257): a, c, t, g, unknown or other
  modified_base (263)..(263): a, c, t, g, unknown or other
  modified_base (297)..(297): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtccgtcaccatcctcctgcacgtggaccagcagtgatgtgtnntatactntntctcngtaccngcaccaccagacaacgcccctattcttaatttgntacaactaccgccctgtacgggtcctgactcgtcttaccccgccggtctcgtacgtcgtacggacctaacgtccgccctaccgtcacctagtctacgtcgactcgagctagacgtagtcgggtaggtacttaactttcgcgtcgtcgtaacttcgtaaagtcgtacgacgtaaggtacctaaattaagtaacgtggttaccgggtacgttaccgggaagggttaaacggaaaccgtagggttccgaacccggttacgacggttccgacgtaacccgtagtccgttacccgcccgttacgtccttcgttccccg

SEQ ID NO: 423881 - DNA, 503 bp, Homo sapiens
  misc_feature: GZ8MTXP01DPM04.22.46.E02.1.454.CMB.2.raw
  modified_base (330)..(330): a, c, t, g, unknown or other
  modified_base (351)..(351): a, c, t, g, unknown or other
  modified_base (490)..(490): a, c, t, g, unknown or other
  modified_base (493)..(503): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacagtcggtcaccggtctcgttacgcctccaaccgaacgggccccagtcccggtcccttcccccgtggcccnccccgtgccctacgagggacnccacccgtccgaggacgccacgacggcccggtcccccggtggggacttcggcccgttacggggtaaaccaacgggtcccttaccgttacccgaccggtacgtatcggtctaggacgggcggtcgtaggacaaggccganagnnnnnnnnnnn

SEQ ID NO: 423882 - DNA, 614 bp, Homo sapiens
  misc_feature: GZ8MTXP01AS58U.22.46.E02.1.454.CMB.2.raw
  modified_base (200)..(200): a, c, t, g, unknown or other
  modified_base (240)..(240): a, c, t, g, unknown or other
  modified_base (249)..(249): a, c, t, g, unknown or other
  modified_base (251)..(251): a, c, t, g, unknown or other
  modified_base (458)..(458): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacngtcctcaccatctctgcacgtggacagcagtgatgtggtncttatactntntctctgtacagcaccacagacaaccgcccctaattcttaagtttcgactacaactacccgccctacgacgggtcctgactccgtcttccccgtccggtctacccgtaagtccgtaacggaccaacgacccggtccctacccgtacgacctactcgtcgtcggaacctccgaggtccagacgtagtcggtaggttcttaactttacgngtcctgtcctagtaacgtcgtacgacacggtactaattaacgttaaagtggtcggtccgtacggggaacggtaaacggacctaaaggttcgtaaccggtcttacgggttcacgccgtacgcccgtacccgtcccgttacggtccttcgttccccgg

SEQ ID NO: 423883 - DNA, 706 bp, Homo sapiens
  misc_feature: GZ8MTXP01EGQZM.22.46.E02.1.454.CMB.2.raw
  modified_base (244)..(245): a, c, t, g, unknown or other
  modified_base (254)..(254): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtccgtcaccatcctcctgcactgggaccagcagtgatgtggtnntatactatntctctggtacacgcaccaccgacggaccaaaccgacccccctaaacttcttttaaagtttttcggtactactaaaccgtaaccccgccccgttacgtacggggtccctagactcgtcctttccccgtccggtctaccgtaacgtccgtacggacccaaccgacccggtccccttaccccgtacgacctacttccttaccgtacgggtacctaccgacggtccgtaggaacggtagtcgggtaggttacggttactttacgcgtcttcgtacgttactaattacgtcgacgtaggaccttaaacgtaaattacgttagtaccgggttccggttaccggggaacgggtacggaaacggtaaacggttcggtaacccggtaccggttacggttaccgaccggtccccgaaggtcccttacccggtccccgttacgggtcccttaaccgtttcccg

SEQ ID NO: 423884 - DNA, 700 bp, Homo sapiens
  misc_feature: GZ8MTXP01CZQX7.22.46.E02.1.454.CMB.2.raw
  modified_base (232)..(232): a, c, t, g, unknown or other
  modified_base (247)..(247): a, c, t, g, unknown or other
  modified_base (257)..(257): a, c, t, g, unknown or other
  modified_base (259)..(259): a, c, t, g, unknown or other
tcagacatacgcgtcacgaccggtgctcgatttagactcatctacaggggaaaggggggggtctcaggaggcagcactctcgggacgtctccaccatggcctgggctctgctcctcctcagcctcctcactcagggcacaggatcctgggctcagtctgccctgactcagcctcgctcgagtcgtccggtctccgtggacagtccgtcaccatcctcctgcacgtgggaccngcagtgatggttgtncttataactntntctctgtaccagccaccaccagacaaccgccccctaattctttaagtttcggactacaactaccccgccctacggacgggtcctgactcgtccttccccgccggctaccgagtcctaacgggaccaaccgccggtccctaccccgtacgaccctacttccgtaccgtcggtaacctccgagggtctacggacgtagtagggacggttcttaacctttcgcggtactcggtactactaagttacgacgggtacaaacggtaactaaaccgttaaattaaacgttcgggtcggttaacccgggttcggggtaaaccgggacgggttaaacccttaaacggccggtacccgttaccggttaacggttacccgttaccgggtaacccccgaagggttccccgttcccggccccccgttacgggtaacccttcccgttttccccgg

SEQ ID NO: 423885 - DNA, 613 bp, Homo sapiens
  misc_feature: GZ8MTXP01EA4F4.22.46.E02.1.454.CMB.2.raw
  modified_base (213)..(213): a, c, t, g, unknown or other
  modified_base (244)..(244): a, c, t, g, unknown or other
  modified_base (258)..(258): a, c, t, g, unknown or other
  modified_base (362)..(362): a, c, t, g, unknown or other
  modified_base (463)..(463): a, c, t, g, unknown or other
  modified_base (491)..(491): a, c, t, g, unknown or other
tcagacatacgcgtcacgaccggtgctcgatttagactcatctacaggggaaaggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtccgtcaccntcctctgcacgtggaccagcagtgatgtggncttatactatgtcnctggtacagcaccaccaggaccaaacgcccccaattcgtttaatttttggactactaaactaaccccgccccgtagacgggggtccctagactcgcctttcccnccggctaccgagttcgtacgggaccaacgccggtccctcccctagacccattcctacgtcggactccgacggtctagacgagtggtaggtgtactttacgngtctcgcgtctagtctcgagaccggtanaagttaatagttagtcggttcgttcgggaacggtacggttaaacgaaggttccgaccgtcggttacggccaaccggcccgaacggtcctccgggtccccttaccggttcaacccgtttcccg

SEQ ID NO: 423886 - DNA, 630 bp, Homo sapiens
  misc_feature: GZ8MTXP01DZCIC.22.46.E02.1.454.CMB.2.raw
  modified_base (345)..(345): a, c, t, g, unknown or other
  modified_base (357)..(357): a, c, t, g, unknown or other
tcagacatacgcgtcacgaccggtgctcgatttagactcatctacaggggaaaggggggggtctcaggaggcagcactctcgggacgtctccaccatggcctgggctctgcctcctcctcagccctcctcactcagggcacaggatcctgggctcagtctgccctgactcagcctcgctcagtcgtccgggtctccgtggacagtccgtcaccatctcctgcacgtgggaccagcagtgatggttggtgtacttataactatgtctctgtaccagccaccaccacggaccaaccgccccctaattctttaagtttcgatacaactacccgccctacgacggtccngactcgctcccnccgctcagtctacgcaacgcgtccctcctacgacctactctcgtacgctcgagtcgtgacgtagtggaggttctactttacgcgtctcgtctactattacgtacgactaacgactaaacgttaattaacgttggttcgggttacgttacggggaacgggtaaacggaaaccgtaaacggttaccgtaacccggttaacgttacggttaccgaacccggtaacccgtaacggtcccgtacccgtcccccggttacgtcccttaacccgttcccg

SEQ ID NO: 423887 - DNA, 514 bp, Homo sapiens
  misc_feature: GZ8MTXP01BLABS.22.46.E02.1.454.CMB.2.raw
  modified_base (315)..(315): a, c, t, g, unknown or other
  modified_base (320)..(320): a, c, t, g, unknown or other
  modified_base (500)..(514): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtccttgatgtcgtggggccctgggacagtcggtcaccgtctctacgcctaccacgacggccctagtccggtccttccccgnggccncccctgcctcgaggcgccacccgtccgagacgccacgacggcccggtcccccgtggggctacggtccccgtagggtaaacccaaacgggtcccttaccgtttcccgaaccgggtaccgttaagtcgggttaccgtagggtacggcccggggtcgtcgggacgtaaacggcgactagtagnnnnnnnnnnnnnnn

SEQ ID NO: 423888 - DNA, 618 bp, Homo sapiens
  misc_feature: GZ8MTXP01EDYVW.22.46.E02.1.454.CMB.2.raw
  modified_base (245)..(245): a, c, t, g, unknown or other
  modified_base (269)..(269): a, c, t, g, unknown or other
  modified_base (486)..(486): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtggacagtccgtcaccatcctcctgcacgtgggaccagcagtgatgttgngcttatactatgtctctggtaccngccaccaccagacaaccgccccctaattctttaagtttgtacgtacaactaacccgccctacgacgggtccctgactccgtccttccccgtccggtctacctaacgtccgtaacgggacccaaccgcccgggtccccttccccgtagaacccctacttcctacgtcggacctccgagggtctaggaacgtagtgggtaacgggttcgtactttacgngtcgtcgtcgtactatagtagcgagacgtaataaactagtactgtcggtcggtcggacggacgtaaacgcgtacgtacgttacggttcgacgccgaggtccgtccgtaccccgccgtaaccgttcctaaccg

SEQ ID NO: 423889 - DNA, 505 bp, Homo sapiens
  misc_feature: GZ8MTXP01DJC87.22.46.E02.1.454.CMB.2.raw
  modified_base (353)..(353): a, c, t, g, unknown or other
  modified_base (490)..(505): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccgtgggtcctttgatgtcgtggggccctgggacaagtcggtcaccgtctcttacgccctccaccgaacgggccctacgtcccggtcccttcccccgtggcccgtcccctcgcctcccgaggacnccaccccgtcgacgacgccacgcggccggcccccgtgggcctcggtcccgtggtaaccgaaacgtccttaccttcccgaacggtcgttactggtcctgggacgggtcgggcgtcggggacgaaacgggcgacagtgnnnnnnnnnnnnnnnn

SEQ ID NO: 423890 - DNA, 582 bp, Homo sapiens
  misc_feature: GZ8MTXP01EK9ND.22.46.E02.1.454.CMB.2.raw
  modified_base (242)..(243): a, c, t, g, unknown or other
  modified_base (252)..(252): a, c, t, g, unknown or other
  modified_base (463)..(463): a, c, t, g, unknown or other
  modified_base (467)..(467): a, c, t, g, unknown or other
  modified_base (502)..(502): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagccctcctcactcagggcacaggatcctggctcagtctgccctgactcagcctcgctcagtcgtccggtctccgtggacagtccgtcaccatctcctgcactgggaccagcagtgatgttgtnnttataactntgtctcgtgtacagcaccacccgagaccaaaccgacccccctaattactttaagttttgtacgtacaaactaacccgcccctagacgggtccctgactcgtccttccccgccggactccgaagtccgtacgacaaccgaccggcccctcctacgacctatctcgcgacctccgaggtctaggaccgtaagtgggtagttcttactttacgntctnctatagtcgagagagactaaatagtatgtgtcggngggaacggaagacgaacgttcgaccgttacgcgccgaacgaaccgtaggtcccgtcccgtcccgttagtccttcccgtcg

SEQ ID NO: 423891 - DNA, 428 bp, Homo sapiens
  misc_feature: GZ8MTXP01AUB0X.22.46.E02.1.454.CMB.2.raw
  modified_base (266)..(266): a, c, t, g, unknown or other
  modified_base (293)..(293): a, c, t, g, unknown or other
  modified_base (296)..(296): a, c, t, g, unknown or other
  modified_base (306)..(306): a, c, t, g, unknown or other
  modified_base (319)..(319): a, c, t, g, unknown or other
  modified_base (396)..(396): a, c, t, g, unknown or other
  modified_base (413)..(428): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggccttgatgtctgggcctgggacatggtcacgtntctagcctcacaggccatcgtctcccngcncctgctcagngccacctcgagcncacgacgccggccccctggctgcccgtggtaacaacgggtctaccttccgaacgtcgtatcgtctggacgcgggtcnggcgaaggctacatagnnnnnnnnnnnnnnnn

SEQ ID NO: 423892 - DNA, 702 bp, Homo sapiens
  misc_feature: GZ8MTXP01BNLVD.22.46.E02.1.454.CMB.2.raw
  modified_base (259)..(259): a, c, t, g, unknown or other
  modified_base (264)..(264): a, c, t, g, unknown or other
  modified_base (271)..(271): a, c, t, g, unknown or other
  modified_base (311)..(311): a, c, t, g, unknown or other
tcagacatacgcgtcacgaccggtgctcgatttagactcatctacaggggaaaggggggggtctcaggaggcagcactctcgggacgtctccaccatggcctgggctctgctcctcctcagccctcctcactcagggcacaggatccgtgggctcagtctgccctgactcagcctcgctcagtcgtccgggtctccgtggacagtccgtcaccatcctcctgcacgtcgggaccagcagtgatggttgtgcttatactntgtcnctgtacngcaccaccagacaacgccccctaattctttaagttttggntacctaactaccccgtccctcgtaccgggtcctgatccgtcttcccgcccggtactcccgaagtccgacggaccaacgacccggtcccctcccgtacgtaccctatccgtacgtaccggaccttacccgaggccgttaggaccggtaaggttcgggtaagggtttcgttaaccttttacgtcgttaccgttcgtaccgttaactagttaacgtacgggaacctacggtaaccttaaacgttaaattaacggttaacgttcgggttccggttacgggggaaccggtaacggggaaaccgtaaacgggttccgggttaacccgtcggttaacggcccttacgggtccccgacggtccgtaccccgcccgttacgtaaccttcccgttaacccg

SEQ ID NO: 423893 - DNA, 479 bp, Homo sapiens
  misc_feature: GZ8MTXP01EDZKO.22.46.E02.1.454.CMB.2.raw
  modified_base (316)..(316): a, c, t, g, unknown or other
  modified_base (458)..(464): a, c, t, g, unknown or other
  modified_base (466)..(479): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaaatgaacagcctgacagccgagacacggctgtctattactgtacgagagattggcaagcctgggtcctttgatgtcgtggggccctgggacagtggtcaccgtctcttagcctccaccaagggcccagttccggtccttcccccgnggccgcccctgcctccgaggcgccacctccgagcgcacgagccggccccctggggctcgccctgggtaaccaaacgggtccttaccttccgacgtccgtatcgtcgtaggaggtcggggctcggacgtaaggcgacaagtgnnnnnnngnnnnnnnnnnnnnn

SEQ ID NO: 423894 - DNA, 708 bp, Homo sapiens
  misc_feature: GZ8MTXP01A1E3F.22.46.E02.1.454.CMB.2.raw
  modified_base (348)..(348): a, c, t, g, unknown or other
tcagacatacgcgtcacgaccggtgctcgatttagactcatctacaggggaaagggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgtggtgcttataactatgtctctggtacagcaccaccaggacaacgcccccaactcttaatttgtgtacaactaacccgcccctcgacggggtccctgactcgtcttcccnccggctcccgaaagtctacgggacaaccgaccgggaccctcccctacgaaccctactccgttacgtcgggacccttaccgacggtccgtacggaaccgtaagtacgggtaaggggttacgtaaccttttttaaccggtcgtaccgtacgtaccgttacgtaacgttacgtacgaccgaacgtaacttaaacgttaaattaaacgttacggttacgggttaccggttacggggaaccggggtaaacgggttaaacccgtaaacggttaccggtaacccggttaccgttaaccggttcgaacccggtaacccggaacggtcccgtccccggacccccgttacggtcccgttaaccgttcccg

SEQ ID NO: 423895 - DNA, 590 bp, Homo sapiens
  misc_feature: GZ8MTXP01AI4OL.22.46.E02.1.454.CMB.2.raw
  modified_base (305)..(305): a, c, t, g, unknown or other
  modified_base (344)..(344): a, c, t, g, unknown or other
  modified_base (366)..(366): a, c, t, g, unknown or other
  modified_base (430)..(430): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgtgtgcttataactatgtctctggtaccagccaccaccagaccaaacgcccccaattctttaattttggntacaactaccgccctcgacgggtcctgactcgcttcccnccggctccagtctacgccaacnccggccctccacgaccatctctacggctccgaggctgacgagtggacgggttctacttttacgngtctgctacagtatcgactaggactaacgttaataacgtagttcgggtaccgttcggggaacgggtacgggaaacctaaaggttcgtaacccgttcgacggttacgaccgaacccgtacggtaaccgtcccgtcccccgttcggtccttaaccgttcccg

SEQ ID NO: 423896 - DNA, 446 bp, Homo sapiens
  misc_feature: GZ8MTXP01B613T.22.46.E02.1.454.CMB.2.raw
  modified_base (309)..(309): a, c, t, g, unknown or other
  modified_base (434)..(446): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtgggccctgggacatcggtcacgtctctagcctccaccaacggcccatccggtccttccccgnggccgccctgctccaggacgcacccgtcgagagccacgacggccggcccccgtgggctgcccgtggtacaacgcctactccgacgcgtatcgtcgtgacgcgggactgggcaagggcgacatagnnnnnnnnnnnnn

SEQ ID NO: 423897 - DNA, 444 bp, Homo sapiens
  misc_feature: GZ8MTXP01B0ASG.22.46.E02.1.454.CMB.2.raw
  modified_base (306)..(306): a, c, t, g, unknown or other
  modified_base (310)..(310): a, c, t, g, unknown or other
  modified_base (324)..(324): a, c, t, g, unknown or other
  modified_base (337)..(337): a, c, t, g, unknown or other
  modified_base (433)..(433): a, c, t, g, unknown or other
  modified_base (435)..(444): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacatggtcacgtctctacgcctccacacggcccatccggtcctccccgngccnccctgctcgaggcnccacctcgagacncacgcgccggccccctggggctcgccctggtaccaaacggtcctaccgttcccacgtcgtatcgtcgtggacggtcggctgggacaaggcgctagngnnnnnnnnnn

SEQ ID NO: 423898 - DNA, 488 bp, Homo sapiens
  misc_feature: GZ8MTXP01AI7JC.22.46.E02.1.454.CMB.2.raw
  modified_base (461)..(461): a, c, t, g, unknown or other
  modified_base (467)..(468): a, c, t, g, unknown or other
  modified_base (470)..(474): a, c, t, g, unknown or other
  modified_base (476)..(488): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtcctttgatgtcgtggggccctgggacagtcggtcaccgtctctacgcctccaccgaggcccagtccgtccttccccctggccgccctgcctccgaggacgccacccgtccgagacgccacgacggccggcccccgtggggctcggcccgtggtaacccacggtaacctaccgttccgaccgtacgtagtcgtcgtcggacggtcgggcgtgggaccaagggcccgnaagtgnngnnnnngnnnnnnnnnnnnn

SEQ ID NO: 423899 - DNA, 506 bp, Homo sapiens
  misc_feature: GZ8MTXP01DEDZV.22.46.E02.1.454.CMB.2.raw
  modified_base (348)..(348): a, c, t, g, unknown or other
  modified_base (490)..(496): a, c, t, g, unknown or other
  modified_base (498)..(506): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccgtgggtcctttgatggtcgtgggggccctgggacaagtggtcaccgtctcttacgcctccaccgaacgggcccattccggtccttccccccgtggccgccccttgccctccgaggacnccacccttccgagacgccacgacgcccggcccccgtcggggcctggcccgtcggtaaccgaaacgggtccttaccttccccgaccggtcgtacttcggtcgtcggaggccggggtctcggggacaagggccggactataggnnnnnnngnnnnnnnnn

SEQ ID NO: 423900 - DNA, 788 bp, Homo sapiens
  misc_feature: GZ8MTXP01A6J37.22.46.E02.1.454.CMB.2.raw
tcagacatacgcgtcacgaccggtgctcgatttagactcatctacagggaaaggggggggtctcaggaggcagcactctcggaacgtctccaccatggcctgggctctgctcctcctcagcctcctcactcagggcacaggatcctgggctcagtctgccctgactcagcctcgctcagtcgtccgggtctcctggacagtccgtcaccatctctgcactgggaccagcagtgatgttggtctacttatactatgtctctcggactacgccaaccgacccgaggaccaaaccgtaccccctaaacttaccgttttaagtttttcggtcgtaaacctaaccgttaaccccgccccttacgggtaaccgggttccctacgtaccgtccgtaccgtttcccccgtcccgggtacctacgtaaaccggtttccgtacggaacccgtaacccgtaccgggtcccccctacccttaccgggacccgttaactccccgtttacgtacccgggacccttacccggaacggtacccgttaggaaacccggttaagggtacgggttaacgggggttacgtttaaaccttttacgtaccggtttacgttaccggttaacgttaacgtaacgttaccgtacgtaaacgttaacgtaacttaaacgttaaagttaacgttacggtaccggttcgggtaacggggtaacggaacggttacgtaaacggttccgtaaccggtcgttacggttcaaccggtccgtacggtccgccccggtaccgttacgtccgttaaccgtccg

SEQ ID NO: 423901 - DNA, 525 bp, Homo sapiens
  misc_feature: GZ8MTXP01A36UU.22.46.E02.1.454.CMB.2.raw
  modified_base (489)..(489): a, c, t, g, unknown or other
  modified_base (491)..(491): a, c, t, g, unknown or other
  modified_base (493)..(525): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagcccgagacacggctgtctattactgtacgagagattggacaagcctggggtcctttgattgtcgtggggccctgggaccagtcggtcaccgtctcttcgcctccacgaacggcccagtcccggtccttccccgtgccgccctgcctccgaggctccgactcccgagagtccacgacgtccggccccctggggcctggccctaggaacccaaacgggcttaccgttacccacgtcgtaacgtcggtacgtcggacggccggggtactgggggaacaaacggggccccgttaaaacgtgtacggngngnnnnnnnnnnnnnnnnnnnnnnnnnnnnnnnnn

SEQ ID NO: 423902 - DNA, 410 bp, Homo sapiens
  misc_feature: GZ8MTXP02JBECO.22.46.E02.1.454.CMB.2.raw
  modified_base (405)..(410): a, c, t, g, unknown or other
tcagacatacgcgtcacgaccggtgctcgatttagactcatctacagggaaagggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcacgtctcttagcctcaccaaggcccatcggtctcccctgcgccctgctccaggagcacctccgagagcacagcgccccctgggctgcctggtcaaggctacttccacgcgtatgtctgagcggctggcaaggcgcatagnnnnnn

SEQ ID NO: 423903 - DNA, 422 bp, Homo sapiens
  misc_feature: GZ8MTXP02HCUSB.22.46.E02.1.454.CMB.2.raw
  modified_base (417)..(422): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctctttagcctccaccaaggcccatcggtcttcccctggcgccctgcctccaggacgcaccctccgagcgcacagcggccccctgggctgcctggtcaaggctacttccacgcgtatgtctgagcgggctggcaaggcgcatagnnnnnn

SEQ ID NO: 423904 - DNA, 413 bp, Homo sapiens
  misc_feature: GZ8MTXP02FV63E.22.46.E02.1.454.CMB.2.raw
  modified_base (322)..(322): a, c, t, g, unknown or other
  modified_base (408)..(413): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaaggcccatcggtctcccctgcgccctgctccaggngcacctccgagagcacagcggccccctgggctgcctggtcaaggctactcacgcgtatgtctgagcgggctggcaaggcgcatagnnnnnn

SEQ ID NO: 423905 - DNA, 417 bp, Homo sapiens
  misc_feature: GZ8MTXP02IGL8C.22.46.E02.1.454.CMB.2.raw
  modified_base (412)..(417): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctctttagcctccaccaaggcccatcggtctcccctggcgccctgctccaggagcacctccgagagcacagcggcccctgggctgcctggtcaaggctacttccacgcgtatgtctgagcgggctggcaaggcgcatagnnnnnn

SEQ ID NO: 423906 - DNA, 414 bp, Homo sapiens
  misc_feature: GZ8MTXP02H9RPK.22.46.E02.1.454.CMB.2.raw
  modified_base (411)..(414): a, c, t, g, unknown or other
tcagacatacgcgtcacgaccggtgctcgatttagactcatctacagggaagggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctgggccctgggacaatggtcacgtctcttagcctcaccaaggccatcggtccttcccctggccgccctgctccaggacgcacctccgagacgcacagcggccccctgggctgcctggtcaaggctacttccacgcgtatcgtctgagcgggctggcaaggcgcatagnnnn

SEQ ID NO: 423907 - DNA, 532 bp, Homo sapiens
  misc_feature: GZ8MTXP02H1QH8.22.46.E02.1.454.CMB.2.raw
  modified_base (236)..(236): a, c, t, g, unknown or other
  modified_base (245)..(245): a, c, t, g, unknown or other
  modified_base (360)..(360): a, c, t, g, unknown or other
  modified_base (380)..(380): a, c, t, g, unknown or other
  modified_base (414)..(414): a, c, t, g, unknown or other
  modified_base (426)..(426): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatgtgngctatactntgtctctggtaccagcaccacccaggaccaaacgccccccaatctttaatttggtgtacaactaacccgccctcgacgggtcctagatcgcttccctccgctccagtctggcacncgcctccctgaccactctcngacctcgagctgacgatcgaggtgacttttacgngtctgctcatangcagcaactataatacgtgtcgttacgggacggtacggaccaaagtcgaaccgtaccgtacggtcaacgcccgaaggtcctccggccccctcggtcctacgtcccg

SEQ ID NO: 423908 - DNA, 525 bp, Homo sapiens
  misc_feature: GZ8MTXP02JH2CR.22.46.E02.1.454.CMB.2.raw
  modified_base (300)..(300): a, c, t, g, unknown or other
  modified_base (316)..(316): a, c, t, g, unknown or other
  modified_base (356)..(356): a, c, t, g, unknown or other
  modified_base (414)..(414): a, c, t, g, unknown or other
  modified_base (435)..(435): a, c, t, g, unknown or other
tcagacatacgcgtcacgaccggtgctcgatttagactcatctacagggaaagggggtctcaggaggcagcactctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggcaaaccccccatcatcatttatgtntcactcgtcggccctnaggagtctctcatcgccttctcagctcaagtctggcaacnccggcctccctaaccatcctctcgggctcccagtttgaggacgagtctacttattacngtcagttcctttaaataggcncactctcgtgtttcggcgtaggcacgaagtcgaccgtcgtcggtcacgcctacggcctgccccctcggtccactctcgtccccgcctccc

SEQ ID NO: 423909 - DNA, 427 bp, Homo sapiens
  misc_feature: GZ8MTXP02FWV9W.22.46.E02.1.454.CMB.2.raw
  modified_base (421)..(427): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggcccatcggtcttccccctggccgccctgctccaggacgcaccctccgagagcacagccggccccctggggcctgcctggtcaaggctacttccacgcgtatgtctgagcgggctgggcaaggcgcatagnnnnnnn

SEQ ID NO: 423910 - DNA, 419 bp, Homo sapiens
  misc_feature: GZ8MTXP02GXXQ5.22.46.E02.1.454.CMB.2.raw
  modified_base (406)..(406): a, c, t, g, unknown or other
  modified_base (412)..(419): a, c, t, g, unknown or other
tcagacatacgcgtcacgaccggtgctcgatttagactcatctacagggaaaggggctggagtggatttcatatattaaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcacgtctctttagcctccaccaaggcccatcggtctccccctgcgccctgctccaggagcacctccgagagcacagcggccccctgggctgcctggtcaagggctacttcacgcgtatgtctgagcgggctggcaaggcncatagnnnnnnnn

SEQ ID NO: 423911 - DNA, 517 bp, Homo sapiens
  misc_feature: GZ8MTXP02IYV1E.22.46.E02.1.454.CMB.2.raw
  modified_base (302)..(302): a, c, t, g, unknown or other
  modified_base (399)..(399): a, c, t, g, unknown or other
  modified_base (410)..(410): a, c, t, g, unknown or other
  modified_base (425)..(425): a, c, t, g, unknown or other
tcagacatacgcgtcacgaccggtgctcgatttagactcatctacagggaaagggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctctggtaccagcaccaccaggaccaaagcccccaatcttaattttggtntcaataaccgccctcagggtccctgactcgcttcctccgctcaagtctggcacacgcctcctgaccatctctggactccaggctgacgatgagggtntacttttacgngtctgtctactatangacacgactaataataatagtcggtcgtcggacggacggaacaagtacgtaccgtacgtacgcacgaaccgaggctcgcccgtcgtcacgtc

SEQ ID NO: 423912 - DNA, 417 bp, Homo sapiens
  misc_feature: GZ8MTXP02GKEUQ.22.46.E02.1.454.CMB.2.raw
  modified_base (410)..(417): a, c, t, g, unknown or other
tcagacatacgcgtcacgaccggtgctcgatttagactcatctacagggaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaggcccatcggtcttcccctggccgccctgctccaggacgcacctccgagacgcacagcggcccctgggctgcctggtcaaggctactccacgcgtatgtctgagcgggctggcaaggcgcatagnnnnnnnn

SEQ ID NO: 423913 - DNA, 424 bp, Homo sapiens
  misc_feature: GZ8MTXP02H0K73.22.46.E02.1.454.CMB.2.raw
  modified_base (309)..(309): a, c, t, g, unknown or other
  modified_base (339)..(339): a, c, t, g, unknown or other
  modified_base (413)..(413): a, c, t, g, unknown or other
  modified_base (419)..(424): a, c, t, g, unknown or other
tcagacatacgcgtcacgaccggtgctcgatttagactcatctacagggaaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctctttagcctccaccaaggccccatcggtcttccccnggccgccctgcctccaggagcacctccganagcacagcggccccctgggctgcctggtcaagggctacttccacgcgtatgtctgagcgggctggcaagggccncatagnnnnnn

SEQ ID NO: 423914 - DNA, 555 bp, Homo sapiens
  misc_feature: GZ8MTXP02GNHR5.22.46.E02.1.454.CMB.2.raw
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccaccaggcaaacgcccccaatcttaattttgtgtcaactaaccgccctcacggggtccctgactcgtcttcctccgctccaagtctggcacaccggcctccctcgaccatcctctcgacctccaggctagacgagtcggagggttcgtactttacgtgtctgctctatagtgacaggactaacttaataaattagtggttcttcgggacggtacgggaaccaaaggtcgaccgttaccgacggtcacgcccgaaggcctccggtcccccgtcggtcctaccttccg

SEQ ID NO: 423915 - DNA, 525 bp, Homo sapiens
  misc_feature: GZ8MTXP02H6XFW.22.46.E02.1.454.CMB.2.raw
  modified_base (504)..(525): a, c, t, g, unknown or other
tcagacatacgcgtcacgaccggtgctcgatttagactcatctacagggaagggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacgctgtctattactgtacgagagattggcaagcctgggctttgatgtcgtggggccctggggacaagtggtcaccgtctctttagcctccaccaacggccccagtccggtccttccccctggccgccctgcctccaggacgccaccgtccgagacgccacgacggccggccccccctggggccctcggcccgtttggggtacccgaaaacggggtccctttaaccgtttcccccgaaaccggttcccggttaatcgggttcctggaacgggtcccgggggctcgggggcaaacggggccgacgaagtaggnnnnnnnnnnnnnnnnnnnnnn

SEQ ID NO: 423916 - DNA, 527 bp, Homo sapiens
  misc_feature: GZ8MTXP02FQ1RB.22.46.E02.1.454.CMB.2.raw
  modified_base (302)..(302): a, c, t, g, unknown or other
  modified_base (330)..(330): a, c, t, g, unknown or other
  modified_base (409)..(409): a, c, t, g, unknown or other
  modified_base (418)..(418): a, c, t, g, unknown or other
  modified_base (423)..(423): a, c, t, g, unknown or other
  modified_base (431)..(431): a, c, t, g, unknown or other
  modified_base (434)..(434): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatcctcctgcactgggaccagcagtgatgttggtgcttataactatgtctctggtaccagcaccaccagcaaacgcccccaatcttaattttgtntacaataacccgccctcacgggtccccngatcgcttcctccgctcaagtctggcacacgccctccgtgaccatcctactcggacctccaggctagacgatgagggtntactttacngctcnctatatanganacgactaaatataatagtcgtcgtcgggacggaggaacaagtcgtaccgtacgtacgcgacgaaccgacgcctccgcccgtcgtcctactccg

SEQ ID NO: 423917 - DNA, 425 bp, Homo sapiens
  misc_feature: GZ8MTXP02FZTKH.22.46.E02.1.454.CMB.2.raw
  modified_base (302)..(302): a, c, t, g, unknown or other
  modified_base (306)..(306): a, c, t, g, unknown or other
  modified_base (417)..(425): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctgggccctgggacaatggtcaccgtctcttagcctccacaaggccatcgtctccccngccncctgctccagcgccacctccgagacgcacacgccggcccctggggcctgccgtggtaccaaggtcctacttccacgtcgtatgtctgagcgggctgggcaaggcgcatagnnnnnnnnn

SEQ ID NO: 423918 - DNA, 416 bp, Homo sapiens
  misc_feature: GZ8MTXP02IP1S9.22.46.E02.1.454.CMB.2.raw
  modified_base (412)..(416): a, c, t, g, unknown or other
tcagacatacgcgtcacgaccggtgctcgatttagactcatctacagggaagggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctctttagcctccaccaaggcccatcggtcttcccctggcgccctgctccaggagcacctccgagagcacagcggccccctgggcctgcctggtcaaggctacttccacgcgtatgtctgagcgggctggcaaggcgcatagnnnnn

SEQ ID NO: 423919 - DNA, 432 bp, Homo sapiens
  misc_feature: GZ8MTXP02FV2EX.22.46.E02.1.454.CMB.2.raw
  modified_base (424)..(432): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggccccatccggtccttccccctggccgccctgcctccaggacgcaccctcgagacgcacagcggccccctgggcctgcctggtccaaggcctacttccacgcgtatgtctgagcgggctggcaaggcgcatagnnnnnnnnn

SEQ ID NO: 423920 - DNA, 625 bp, Homo sapiens
  misc_feature: GZ8MTXP02HRFR7.22.46.E02.1.454.CMB.2.raw
  modified_base (237)..(237): a, c, t, g, unknown or other
  modified_base (296)..(296): a, c, t, g, unknown or other
  modified_base (332)..(332): a, c, t, g, unknown or other
  modified_base (420)..(420): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgtgngctataactatgtctcctggtaccagcaccaccagcaaacgcccccaatcttaatttgngtcaataccgccctcagggtccctgatcgcttcccnccgctccaagtctcggcaccacggcctccctgaccactctctcggactccgaggtctgaccgagtggtaagggtgtacctttttacgngtccttggtccttactaattcgcgacgaggacctaaattaattaaacgttagtcggttaccggttaccggggacggggtaaacgggaaaccgttaaaacgggtccggttaacccgttaaccggtacggttaccgaacccgtaacccggaaaccggtccgttacccccggacccccgttccgggtaaccttacccgtttcccccgg

SEQ ID NO: 423921 - DNA, 427 bp, Homo sapiens
  misc_feature: GZ8MTXP02IC6L7.22.46.E02.1.454.CMB.2.raw
  modified_base (422)..(427): a, c, t, g, unknown or other
tcagacatacgcgtcacgaccggtgctcgatttagactcatctacagggaaagggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtccttcccctggcgccctgctcccaggagcaccctccgagagccacagcggccccctggggctgccgtggtcaaacggctaccttccacgcgtatggtctgagcggctggcaaggcgcatagnnnnnn

SEQ ID NO: 423922 - DNA, 549 bp, Homo sapiens
  misc_feature: GZ8MTXP02GMBOQ.22.46.E02.1.454.CMB.2.raw
  modified_base (416)..(416): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccaccaggcaaacgccccccaatcttaattttggtgtcaataaccgcccctcaggggtccctgactcgcttcctccgctcaagtctggcacacggcctccctgaccatctctgactcccaggctgacgatcggagggtgacttttacngtctgctcatatggcaggcaaactataaatatggtcttcgggacggaggggaccctaaaaggttcggacccgtccgtaaggttccaacggccccgtaaagggcctacggtccccccctgggtcctacttcccg

SEQ ID NO: 423923 - DNA, 562 bp, Homo sapiens
  misc_feature: GZ8MTXP02JRUY1.22.46.E02.1.454.CMB.2.raw
tcagacatacgcgtcacgaccggtgctcgatttagactcatctacagggaaaggggggtcgtcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatgttggtgcttataactatgtctcctggtaccagcaccaccagcaacgcccccaatcttaatttgtgtcaactaaccgcccctcacgggtccctgatcgtctcctccggctccaagtctgcacgaccggcctccctgaccatctctgactccgagctgacgatgaggtgtactttatgcctgactcatagtgacctaggacaaacttataaatagttcggttacttcgggacggaggggtacccaaaaggttcggacccgttccgtaacggttcgaacgtcccccggaaaaggtccctacggccccccgtcgggtaacctacctttcccg

SEQ ID NO: 423924 - DNA, 601 bp, Homo sapiens
  misc_feature: GZ8MTXP02HIUYI.22.46.E02.1.454.CMB.2.raw
  modified_base (240)..(240): a, c, t, g, unknown or other
  modified_base (426)..(426): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatgttggtncttataactatgtctcctggtaccagccaccaccaggaccaaaccgccccccaaattctttaatttcggtgtactaaactaaccccgcccctacgacggggtcccctagactcgtcttcccgtccgctaccaagtctcggacaccgaccggtcctccctgaccctatcctcgtgacctccgagtcngacgtagtaggaggttcgtactttacgcgtcttcgctctatatgacagacaactataatagtggtacgttcgggacggaacgggtaaccaaacggtcggtaacccgttaccgtacggtaccgacgaacccgaacggtccctaccggtcccccgttcggtaccctacgtttccccg

SEQ ID NO: 423925 - DNA, 520 bp, Homo sapiens
  misc_feature: GZ8MTXP02I9H3A.22.46.E02.1.454.CMB.2.raw
  modified_base (305)..(305): a, c, t, g, unknown or other
  modified_base (360)..(360): a, c, t, g, unknown or other
  modified_base (420)..(420): a, c, t, g, unknown or other
  modified_base (434)..(434): a, c, t, g, unknown or other
  modified_base (480)..(480): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggccaaacgcccccaactcttaattttggntcaataccgcccctcagggtccctgactcgcttcctccgctcaagtctggcaccncggccctcctgaccatctctcgacctccaggctgacgtatcggagggtcgtacttttacngtctgactctaatntgacaggcaactataatagtggtcttcggacggtacggacaaacgngaccgtcacggtcacgccaaggctcgcccctgctactccg

SEQ ID NO: 423926 - DNA, 425 bp, Homo sapiens
  misc_feature: GZ8MTXP02JU0XE.22.46.E02.1.454.CMB.2.raw
  modified_base (306)..(306): a, c, t, g, unknown or other
  modified_base (416)..(416): a, c, t, g, unknown or other
  modified_base (418)..(425): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctcttagcctccaccaggcccatcggtcttccccngcgccctgctccaggagcacctccgagagcacagcggcccccctggggctgccctggtccaagggcctacttccacgcgtatgtctgagcggggctggcaaggcgctagngnnnnnnnn

SEQ ID NO: 423927 - DNA, 541 bp, Homo sapiens
  misc_feature: GZ8MTXP02H5Z6X.22.46.E02.1.454.CMB.2.raw
  modified_base (226)..(226): a, c, t, g, unknown or other
  modified_base (298)..(298): a, c, t, g, unknown or other
  modified_base (413)..(413): a, c, t, g, unknown or other
  modified_base (423)..(423): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtcccgggtctcctggacagtccgtcaccatctcctgcactgggaccngcagtgatgttggtgcttataactatgtctcctggtaccagcaccaccagcaacgcccccatcttatttgtntcaataccgccctcgagggtccctgactcgtcttcctccggcctcaagtctggacacgaccggcccttcccgagacccactcctctcggacctccgaggctgacgtatgagggtntactttacgngctgctctatatgcacgacaactatatagtggtcgttacgggcggacgggaacctaaacgtcgaccgtaccgtacggtcacgcccgaacggacctcgaccccctcggtcctaccctcg

SEQ ID NO: 423928 - DNA, 696 bp, Homo sapiens
  misc_feature: GZ8MTXP02G34BO.22.46.E02.1.454.CMB.2.raw
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactggaccagcagtgatgtgtgcttataactatgtctcctgtaccagcaccaccagcaaacgcccccaatcttaatttgtcgtacaactaacccgccctcgacgggtccctgtactcggtccttcccgtccggtcctacctaagtcctcgggacctaccgaccgggtcccttaccccgtacgaccctaacttccgttacccgtacggtacccttacccgaacgggcccttacggaacccggtaattccggggtaaagggggttaccggttaaccttttttaaaccgcggttaccttacggtcccttacctaaagttaagttcgggacctaacgggacctaaaaccttacgtaaaacttagttcggttaccgtttacgggacgggtaacgggtaaccctaaaagggtcgaccccgttacgtaacggtccaacgaacccccgaaggtccctaccggcccccgttacggtcctaacgttccccg

SEQ ID NO: 423929 - DNA, 518 bp, Homo sapiens
  misc_feature: GZ8MTXP02HJ5VS.22.46.E02.1.454.CMB.2.raw
  modified_base (239)..(239): a, c, t, g, unknown or other
  modified_base (300)..(300): a, c, t, g, unknown or other
  modified_base (317)..(317): a, c, t, g, unknown or other
  modified_base (390)..(390): a, c, t, g, unknown or other
  modified_base (398)..(398): a, c, t, g, unknown or other
  modified_base (408)..(408): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggngcttataactatgtctcctggtaccagcaccaccaggcaaagcccccaatcttaattttgngtcaataaccgcccctnagggtccctgatcgcttcctccgctccaagtctggcacacggcctcctgaccatctctgactccagctgacgntgagggtnacttttacgngtctcgctctatatgacagacaaatataatgtgtcgtcgggacggacggaacaaacgtcgaccgtcgtacgtcacgcccgaaggcctccgtccccgtcggtaccacgtcg

SEQ ID NO: 423930 - DNA, 656 bp, Homo sapiens
  misc_feature: GZ8MTXP02H07IX.22.46.E02.1.454.CMB.2.raw
  modified_base (248)..(248): a, c, t, g, unknown or other
  modified_base (250)..(250): a, c, t, g, unknown or other
  modified_base (414)..(414): a, c, t, g, unknown or other
tcagacatacgcgtcacgaccggtgctcgatttagactcatctacagggaaagggggggtctcaggaggcagcactctcgggacgtctccaccatggcctgggctctgcctcctcctcagcctcctcactcagggcacaggatcctgggctcagtctgccctgactcagcctcgctcagtgtccggtctccgtggacagtccgtcaccatcctctgcacgtggacagcagtgatgtgtgctataactntntctctggtaccagccaccaccgaggaccaaacgccccccaaattctttaatttggagtacaactaacccgccctacgacgggtcctagactccgcttcccgccggcctccgtaagtctacggaccaaccgccggtccctcccgtcgaccactctactcgtaccnccgacgcgtacgaccgtagtacggtaggtacgtaccgtttacgtcgtcgtcgtccgtactagtagtcgtacgacggtagtaaacccccccccttaataaacgttaagttacggttacggttaccgggtacgggaacgggtaaaccggtaaacggtacggtaaccggttaccgtaccggtacgtaccggtaacccgaccggtaccgtacccgtaccccgtacccgtcccgtaccgtttccccg

SEQ ID NO: 423931 - DNA, 418 bp, Homo sapiens
  misc_feature: GZ8MTXP02G8HHB.22.46.E02.1.454.CMB.2.raw
  modified_base (343)..(343): a, c, t, g, unknown or other
  modified_base (408)..(408): a, c, t, g, unknown or other
  modified_base (413)..(418): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggcccatcggtccttcccctggcgccctgctccaggacgcacctcgagcgcacngcggccccctggggctgcctggtcaagggctactccacgcgtatgtctgagcgggctggcaggcncatgnnnnnn

SEQ ID NO: 423932 - DNA, 450 bp, Homo sapiens
  misc_feature: GZ8MTXP02HP8LQ.22.46.E02.1.454.CMB.2.raw
  modified_base (436)..(436): a, c, t, g, unknown or other
  modified_base (439)..(439): a, c, t, g, unknown or other
  modified_base (441)..(450): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctctttagcctccaccaaggccccatccggtccttcccccgtggcccgtcccctgcctccgaggacgccaccctccgagacgcacaggccggccccctgggcctcgcctggtccaaggcctacttccacgtcgttatcgtactggacgcggctggcaaggccgnagngnnnnnnnnnn

SEQ ID NO: 423933 - DNA, 425 bp, Homo sapiens
  misc_feature: GZ8MTXP02GT1YZ.22.46.E02.1.454.CMB.2.raw
  modified_base (420)..(425): a, c, t, g, unknown or other
tcagacatacgcgtcacgaccggtgctcgatttagactcatctacagggaaaggggctggagtggatttcatatattaacgatggagggaggacgaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctctttagcctccaccaaggcccatcggtctcccctggccgccctgcctccaggacgccacctccgagagcacagcggccccctggggcctgcctggtcaagggctactccacgcgtatgtctgagcgggctgggcaagggcgcatagnnnnnn

SEQ ID NO: 423934 - DNA, 431 bp, Homo sapiens
  misc_feature: GZ8MTXP02IMY9X.22.46.E02.1.454.CMB.2.raw
  modified_base (323)..(323): a, c, t, g, unknown or other
  modified_base (357)..(357): a, c, t, g, unknown or other
  modified_base (401)..(401): a, c, t, g, unknown or other
  modified_base (417)..(417): a, c, t, g, unknown or other
  modified_base (419)..(419): a, c, t, g, unknown or other
  modified_base (422)..(431): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaatggtcaccgtctcttacgcctccacaacggccatccgtctcccctgccgcctgctcaggcnccacctcgagagcacacgccggccccctgggccngcctggtcaaggcctacttccacgtcgtatgtctgacgtcgggntcgggcgaaggcccgnanagnnnnnnnnnn

SEQ ID NO: 423935 - DNA, 433 bp, Homo sapiens
  misc_feature: GZ8MTXP02HHDII.22.46.E02.1.454.CMB.2.raw
  modified_base (309)..(309): a, c, t, g, unknown or other
  modified_base (424)..(433): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaggcccatcgtctcccctgccnccctgctccaggacgccacctccgagagccacacggccggcccccgtggggcctcgcctggtccaaggcctaccttccacgtcgtatgtctgagcggctggcgaaggtcgcatgnnnnnnnnnn

SEQ ID NO: 423936 - DNA, 626 bp, Homo sapiens
  misc_feature: GZ8MTXP02F7346.22.46.E02.1.454.CMB.2.raw
  modified_base (312)..(312): a, c, t, g, unknown or other
  modified_base (445)..(445): a, c, t, g, unknown or other
  modified_base (456)..(456): a, c, t, g, unknown or other
  modified_base (470)..(470): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcacgtgggaccagcagttatggttggtgcttataactatgtctcctgtaccagccaccacccaggccaaaccgccccccaacttctttaattttggngtaccaactaaccccgcccctcgacggggtccctgactcgtcttcgccccgctccgaagtctggaccaacgccggtcctcccgtacgacctactctcgtcggacctcgacggtctagacgagtggacgggttntacttttacgngtctgtctctattngacgagactaacttataacgttacgtcggttccttacggggacggtacgggaaaccgtaaaggtcggtaacccggttccgtacggtaccaacggtaccccgaaagggcccttacccggacccccgttaccggtcctaccgttcccgtttcccccgg

SEQ ID NO: 423937 - DNA, 555 bp, Homo sapiens
  misc_feature: GZ8MTXP02FVCDO.22.46.E02.1.454.CMB.2.raw
  modified_base (241)..(241): a, c, t, g, unknown or other
  modified_base (304)..(304): a, c, t, g, unknown or other
  modified_base (434)..(434): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtncttataactatgtctcctggtaccagccaccaccaggacaacgcccccaatcttaattttgtntacaactacccgcccctcacggggtccctgactcgcttccctccggctaccagtctcggacacgaccgccctccctcgaccctatcctctcgacctccgaggtctagacgagtggacggtgtactttacngtactgctcatatgcagactaactataatagtcggtcgttacggcggacgggtaccaaaggtcgaccgtccgtacggtcacgcccgaacggcctaccgcccccgtggtacccacgttcccg

SEQ ID NO: 423938 - DNA, 415 bp, Homo sapiens
  misc_feature: GZ8MTXP02HY2O4.22.46.E02.1.454.CMB.2.raw
  modified_base (310)..(310): a, c, t, g, unknown or other
  modified_base (335)..(335): a, c, t, g, unknown or other
  modified_base (411)..(415): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaggcccatcggtctcccctggccncctgctccaggacgcacctccgagngcacagccggcccctgggctgcctgtcaaggctacttcacgcgtatgtctgacgcgggctggcaagggcgcatagnnnnn

SEQ ID NO: 423939 - DNA, 617 bp, Homo sapiens
  misc_feature: GZ8MTXP02GNTLJ.22.46.E02.1.454.CMB.2.raw
  modified_base (457)..(457): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatgttggtgcttataactatgtctctgtaccagcaccaccagaccaaccgccccctaattactttatttggtctacaactaaccccgccctcgacgggtcctgactcgtctccctccgctacacgtctgacacgccgccctccgacgaccactcctcgtcgaccttccgagtctagaccgtagtcggagggttcttacgtttacgcgtcgttcgcgttactatagngtaccgaggtaactaacgttaataaacttcggttacgggtacgttaccggggaacgggtaccggtaaaccgtaaacgggtccgtaacccgttaccgtacgtacccgacgaacccggacggtcccttacccggccccgttcggtaccctaccgtttccccg

SEQ ID NO: 423940 - DNA, 425 bp, Homo sapiens
  misc_feature: GZ8MTXP02FPISX.22.46.E02.1.454.CMB.2.raw
  modified_base (420)..(425): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggcccatcggtcttcccctggcgccctgctccaggcgcaccctccgagagcacacgcggcccccctggggcctgccctggtccaaggtcctacttccacgcgtatgtctgagcgggctggcaggcgcatagnnnnnn

SEQ ID NO: 423941 - DNA, 532 bp, Homo sapiens
  misc_feature: GZ8MTXP02HUEKE.22.46.E02.1.454.CMB.2.raw
  modified_base (242)..(242): a, c, t, g, unknown or other
  modified_base (251)..(251): a, c, t, g, unknown or other
  modified_base (298)..(298): a, c, t, g, unknown or other
  modified_base (373)..(373): a, c, t, g, unknown or other
  modified_base (378)..(378): a, c, t, g, unknown or other
  modified_base (395)..(395): a, c, t, g, unknown or other
  modified_base (413)..(413): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatcctcctgcacgtgggaccagcagtgatgtggtncttatactntgtctctgacagcaccaccagacaaccgccccaattctttaatttgntacaactacccgccctcgacgggtcctgactcgtcttccgtccgctccagtctcggacacgcgcctcctcgaccntctcngactccgagctgacgtntggaggttgtactttcgngtctgtctacgtatactgcagactaacgtatatagtgtcgtcggacggacggaacgaacgtcgtaccgtcgtacgcgacgaacccgtaggcctccggccccttacggtcctaccgttcc

SEQ ID NO: 423942 - DNA, 438 bp, Homo sapiens
  misc_feature: GZ8MTXP02GSWUK.22.46.E02.1.454.CMB.2.raw
  modified_base (429)..(438): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaagtggtcaccgtctctttacgcctccaccaagggccccagtccggtccttccccctggccgcccctgcctccgaggacgcaccctccgagacgcacagcggccccctgggctgcctggtcaaggctctccacgcgtatgtctgagcgggctgggcaaggcgacatagnnnnnnnnnn

SEQ ID NO: 423943 - DNA, 525 bp, Homo sapiens
  misc_feature: GZ8MTXP02JPJXS.22.46.E02.1.454.CMB.2.raw
  modified_base (294)..(294): a, c, t, g, unknown or other
  modified_base (399)..(399): a, c, t, g, unknown or other
  modified_base (409)..(409): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatcctcctgcactgggaccagcagtgatgtgtgcttatactatgtctctggtaccagcaccaccagacaacgcccccatcttatttgntcataaccgccctcgacgggtccctgactcgcttcccgtccgctccaagtctggcacacggcctcccgtgaccatctcgtagctccaggctgacgagtggaggtntactttacgngtctgctcatactcgacagactaaactataatagtcgtactcgggacggacggtaccaaaggttcgaccgtctaacggtcacgccgaacggctccgaccctcggtacctacttccg

SEQ ID NO: 423944 - DNA, 535 bp, Homo sapiens
  misc_feature: GZ8MTXP02JS7S5.22.46.E02.1.454.CMB.2.raw
  modified_base (510)..(510): a, c, t, g, unknown or other
  modified_base (512)..(512): a, c, t, g, unknown or other
  modified_base (514)..(535): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaagtggtcaccgtctctttagcctccaccaaggcccatcgtccttccccctggccgccctgcctccaggacgccaccctccgagacgccacacggccggccccccgtggggcctcggcccgttggggtacccgaaacggggtcccttaacccgtttccccgaaccgggtccgttaacgttcggttccgttaggggaacgggtcccgggggtccttgggggacccgaaaagggggcccgacgaagttaggngngnnnnnnnnnnnnnnnnnnnnnn

SEQ ID NO: 423945 - DNA, 419 bp, Homo sapiens
  misc_feature: GZ8MTXP02HNZBA.22.46.E02.1.454.CMB.2.raw
  modified_base (309)..(309): a, c, t, g, unknown or other
  modified_base (314)..(314): a, c, t, g, unknown or other
  modified_base (347)..(347): a, c, t, g, unknown or other
  modified_base (396)..(396): a, c, t, g, unknown or other
  modified_base (410)..(410): a, c, t, g, unknown or other
  modified_base (415)..(419): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctggggacaagtggtcaccgtctcttagcctccaccaaggcccatcgtccttccccnggccnccctgcctccaggcgccaccctccgagcgcacngccggccccctgggcctgcctggtcaaggctactccacgcgtatgctgngcggctggcaggcncatgnnnnn

SEQ ID NO: 423946 - DNA, 624 bp, Homo sapiens
  misc_feature: GZ8MTXP02FULNN.22.46.E02.1.454.CMB.2.raw
  modified_base (239)..(239): a, c, t, g, unknown or other
  modified_base (301)..(301): a, c, t, g, unknown or other
tcagacatacgcgtcacgaccggtgctcgatttagactcatctacagggaaaggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggngcttataactatgtctcctggtaccagcaccaccaggcaaacgcccccaatcttaattttgngtcaactaaccgcccctcgacggggtccctgactcgtcttcctccggcctccaagtctcggacctaccgccggtcctcccgtgacctactcctctcgtaccttcccgtagtttacgacggtacgtacgtccttactttacttactacgtacttaacggtttaccctttaaagttacggccgtccctaacgttccgtccggttcggtttcggcggtacggccgtaccggtaacgtcgtacccgttccgtcggtccgtaacgcccgtaacggtcctccggtcccccgtcggtccaccgttccgtccgttccccgccctcctcccg

SEQ ID NO: 423947 - DNA, 601 bp, Homo sapiens
  misc_feature: GZ8MTXP02IWODA.22.46.E02.1.454.CMB.2.raw
  modified_base (306)..(306): a, c, t, g, unknown or other
  modified_base (393)..(393): a, c, t, g, unknown or other
  modified_base (427)..(427): a, c, t, g, unknown or other
  modified_base (475)..(475): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatcctcctgcactgggaccagcagtgatgttggtgcttataactatgtctcctggtaccagcaccacccagaccaaacgcccccaattcttaatttggntcaataacccgcccctgacgggtccctgactcgtccttcctccggctccaagtctcggaccacgccggccctccctgacccatctcncgctccgagctgacgatggaggtctacttttacngtctgtctacgtattacgtgtaccaaggcctaaacttattaaaagttntcggggttacccttcgggggtacgggtaacgggtaaacctaaacgggtccggacccgttaccgtaacgggtccaacggcccgtaacggtcctacccggcccccgtacggttaccgtaccctttccg

SEQ ID NO: 423948 - DNA, 429 bp, Homo sapiens
  misc_feature: GZ8MTXP02HQF4Y.22.46.E02.1.454.CMB.2.raw
  modified_base (329)..(329): a, c, t, g, unknown or other
  modified_base (340)..(340): a, c, t, g, unknown or other
  modified_base (421)..(429): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaagtggtcaccgtctctttagcctccaccaaggccccatcgtccttcccctggcgccctgcctccaggncacctccgagngcacagccggccccctgggcctgcctggtccaaggcctacttccacggctatgtctgagcgggctggcaaggcgcagtagnnnnnnnnn

SEQ ID NO: 423949 - DNA, 463 bp, Homo sapiens
  misc_feature: GZ8MTXP02H6FHM.22.46.E02.1.454.CMB.2.raw
  modified_base (323)..(323): a, c, t, g, unknown or other
  modified_base (342)..(342): a, c, t, g, unknown or other
  modified_base (446)..(446): a, c, t, g, unknown or other
  modified_base (450)..(450): a, c, t, g, unknown or other
  modified_base (452)..(463): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgagacacggctgtcttattactgtacgagagtattggacaagtccgtgggtccttgagttgtcggtcggggccctgggacaagtcggtcaccgtctctttacgcctacccacgacggccagtccgtcctccccgngccgcctcgcctcgcgacnccacccgcgagcgcacgcggccggcccgtcggctcgcgtggacaacggtcctaccgttccacgtcgtattcgtacgtgggacggtcggctggaccgaggcctanacgngnnnnnnnnnnnn

SEQ ID NO: 423950 - DNA, 688 bp, Homo sapiens
  misc_feature: GZ8MTXP02HVB87.22.46.E02.1.454.CMB.2.raw
  modified_base (199)..(199): a, c, t, g, unknown or other
  modified_base (229)..(229): a, c, t, g, unknown or other
  modified_base (244)..(244): a, c, t, g, unknown or other
  modified_base (319)..(319): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagccctcctcactcagggcacaggatcctgggctcagtctgccctgactcagcctcgctcagtcgtccgggtctcctggacngtccgtcaccatctcctgcacgtgggaccngcagtgatgttggtntcttataactatcgtctcgtggtaccagccaccacccaggaccaaaccgaccccccaattctttaattttcggtntactaactaccccgcccctacgtacgggtccctagtacgtccgtcttcccctccggtcctccgaacgtcgtacggaccaccgccggtccctaccctacgtaccctacgtcctcgtcgacctaccgtacggctacgacgtagtacgggtacggttacgttacgttttaccgcgtacgttcgtccttacgtaattacgtcggactaacgggtaacctaaacgttaaagttaacgtaggtttaccggttacgttcgggaaccgggtaacgggtaaaccgaaacggtccggtaacccgtaccgtacggttaccgacgaaccccggtaaggtcccgtaccccggaccccgttccggtaacctacccgtttcccg

SEQ ID NO: 423951 - DNA, 417 bp, Homo sapiens
  misc_feature: GZ8MTXP02FH1D0.22.46.E02.1.454.CMB.2.raw
  modified_base (314)..(314): a, c, t, g, unknown or other
  modified_base (327)..(327): a, c, t, g, unknown or other
  modified_base (412)..(417): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctggggacaatggtcaccgtctcttagcctccaccaaggccccatcggtcttccccctggcnccctgctccaggngcacctccgagagcacagcggccccctggggctgcctggtcaaggctactccagcgtatgtctgagcggctggcaggcgcatagnnnnnn

SEQ ID NO: 423952 - DNA, 608 bp, Homo sapiens
  misc_feature: GZ8MTXP02GA8QI.22.46.E02.1.454.CMB.2.raw
  modified_base (253)..(253): a, c, t, g, unknown or other
  modified_base (300)..(300): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatntctctggtaccagcaccaccagacaacgcccccaatcttaatttggntacaactacccgccctcgacgggtccctgactcgtcttccctccggcctaccacgtctcgactaccgccggccctccgtcgacctatcctctcgacctccgagctagacgtagtcggtaggtacttacgtttactcgtacttgactactatagtcggacaacggtacctaaacttaataaattaggtcggttaccgttcggggaacgggtaaaccgggtaacgtaaaacggtccggtacccgttacgtacgggtccaaccgtaacccgaaggtccctcccggcccccgtcggtacctaccgtttcccg

SEQ ID NO: 423953 - DNA, 506 bp, Homo sapiens
  misc_feature: GZ8MTXP02HNIOV.22.46.E02.1.454.CMB.2.raw
  modified_base (341)..(341): a, c, t, g, unknown or other
  modified_base (485)..(506): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgacaaatgaacagcctgacagccgaggacacggctgtctattactgtacgagagattggcaagcctgggtctttgatgtcgtgggccctgggacagtggcaccgtctcttacgcctccaccaaggccccagtccggtccttcccccgtggcccgtcccctgccctaccgaggtacnccaccctccgagacgccacgacggccggcccccgtgggccttcggcccgttaggtaccaaacgggtcccttaccgttaccgaaccgtcgttaagtcgtacgttcggacggtccgggctggggaccgaaagggccgacaagtggnnnnnnnnnnnnnnnnnnnnnn

SEQ ID NO: 423954 - DNA, 652 bp, Homo sapiens
  misc_feature: GZ8MTXP02IR721.22.46.E02.1.454.CMB.2.raw
  modified_base (241)..(241): a, c, t, g, unknown or other
  modified_base (300)..(300): a, c, t, g, unknown or other
  modified_base (423)..(423): a, c, t, g, unknown or other
  modified_base (436)..(436): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtccgtcaccatctcctgcactgggaccagcagtgatgttgngcttatactatgtctctggtaccagcaccaccagacaacgcccccaattcttaatttgntcaactaccgccctcgacgggtccctgactcgtcttcccgtccgctaccaagtctcggaccacgccggtccctcctacgacccatctctcggacctccgagctcgacgtacgtggtacggttntaaccttttacgngtccttgtccttacgtaattacgtcgacccgaggtaccaaacttaagttaaagttacggttcgggttacccgttacgggggaaccggggtaacggggtaaaccctaaaacgggttacccggaaccccggttaccggtaaacgggttaccaacgggaacccccgtaaacgggtcccttccccggacccccgtttacgggtcctaacccgtttccccg

SEQ ID NO: 423955 - DNA, 566 bp, Homo sapiens
  misc_feature: GZ8MTXP02HUI94.22.46.E02.1.454.CMB.2.raw
  modified_base (238)..(238): a, c, t, g, unknown or other
  modified_base (249)..(249): a, c, t, g, unknown or other
  modified_base (251)..(251): a, c, t, g, unknown or other
  modified_base (301)..(301): a, c, t, g, unknown or other
  modified_base (425)..(425): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgtgngcttataactntntctctggtaccagcaccacccaggacaaacgcccccaattcttaatttgngtacaactaaccgccctcgacgggtcctgactcgcttccgtccgctccaagtctacggcaccacggccctcctcgaccactctctcgacctccgacgctgacgatggtaggtgtaaccttttgngtctcgtctctatatgactaggacaactaataagtattcggtacgttcgggacggacgggaaccgaaaacgtcggtaacccgtccgtacggtacaccggaacccgaacgtccgtaccgtccccgtcggtacctacctcccg

SEQ ID NO: 423956 - DNA, 706 bp, Homo sapiens
  misc_feature: GZ8MTXP02FO8HH.22.46.E02.1.454.CMB.2.raw
tcagacatacgcgtcacgaccggtgctcgatttagactcatctacagggaaaggggggggtctcaggaggcagcactctcgggacgtctccaccatggcctgggctctgctcctcctcagccctcctcactcagggcacaggatcctgggctcagtctgccctgactcagcctcgctcagtcgtccgggtctcctggacagtccgtcacctatcctcctgcacgtcgggaccagcagtgattggttggtgcttaatactatgtctccgtggtaccagccaccaccaggaccaaccgcccccctaacttctttaagttttcggtcgtactaactaaccccgccccgtcgacggggttccctgtactccgtccttccccgtcccggtcctaccgtaacggttcctacgggacctaccgaccggtcccctcccgtacgaccctagttcctccgtcgggacctcccgaggtcctacggaacgtacgtggtacgggttgttacttttacgcgtcgtggccttctattactcggacgtaacggactaaattaacgttaagttacggttaggtttccggttacggggaacgggttacggggaaacccttaacgggttacccggtaaccggttacccgttaaacgggtccgaacccggcccggtaaaccggtcccttacccggtcccccgttacggtccctaccgtttccccgg

SEQ ID NO: 423957 - DNA, 689 bp, Homo sapiens
  misc_feature: GZ8MTXP02J1AI9.22.46.E02.1.454.CMB.2.raw
  modified_base (249)..(249): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggacacgtccgtcaccatcctcctgcacgtcgggaccagcagtgtatggttggtntacttataactatcgtcctcgtcggtaccacgccaccaccgacgaccaaaccgtaccccctaattactttaagtttcggactacctaactaccccgccctacggacggtcctgtactcgtcttcccgccgctacacgtcgcgcacgccgccctccgcacctctctcgtcgtacctccgagtcgtacgacgtaggtacgggtacggttacgttacgtttacgcgttacgtacgtctacgtacgttagtacgaaccgtagtaaccttaaacttaacgtttaacgttacggttacggggttacgttaccgggggacgggtaaaccgggtaaccgtaaacgggttaccgtaaccggttaccgtacgggtacccgaaccggtaacccggtaacccggtcccgtccccggtacccccggttaggtacccccccgtagtttcccccg

SEQ ID NO: 423958 - DNA, 471 bp, Homo sapiens
  misc_feature: GZ8MTXP02HQC92.22.46.E02.1.454.CMB.2.raw
  modified_base (463)..(471): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtcctttgatgtcgtggggccctgggacaatggtccacgtctcttgcctccacgaggcccatccggtccttcccctggccgccctgctccaggcgcacctccgagacgcacacggcccggtcccccgtggggcctcggtcccgttggtaccgaaacgggtccttaccgttcccgaacgtcgttaactcgtcgtacggcgggccgggcgtcggacgaagggcgacagtagnnnnnnnnn

SEQ ID NO: 423959 - DNA, 640 bp, Homo sapiens
  misc_feature: GZ8MTXP02G684T.22.46.E02.1.454.CMB.2.raw
  modified_base (241)..(241): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtcgtccgggtctccgtggacagtccgtcaccatctcctgcacgtgggaccagcagtgatgtgncttatactatgtctctgtaccagccaccaccagacaaaccgcccccaattctttaatttgacgtactaactacccgcccctgacggtccctgactcgtctcccgccgtctacagtctggacaccgccgtcctccctagacccatcctacgtcgacctccgacgctagaccgtagtcgggaggttacgttaccgttttacgcgtacttcgaccttactatagtcgacgtaacggactaaacttagtaacgttagttcgggtaccgttacggggaacgggtaacgggtaaaccgtaaacgggtccggtaacccgttaccggtacggtaccgaacccggaacccgtaacgggttccccgtacccggccccccgtttaagggtcccctaacccgtttccccgg

SEQ ID NO: 423960 - DNA, 653 bp, Homo sapiens
  misc_feature: GZ8MTXP02F10GB.22.46.E02.1.454.CMB.2.raw
tcagacatacgcgtcacgaccggtgctcgatttagactcatctacagggaaaggggggggtctcaggaggcagcactctcgggacgtctccaccatggcctgggctctgctcctcctcagcctcctcactcagggcacaggatcctgggctcagtctgccctgactcagcctcgctcagtcgtcccgggtctccgtggacagtccgtcaccatcctcctgcacgtgggaccagcagtgatggtggtgcttataactatcgtctcctaggtaccagcctaccacccaggaccaaaccgccccccaattctttaacgttttggtctacaactaacccgcccctcgaccggggtccctgtactccgtcttccgtcccgcctacacgttctacggacaccgccggtccctcccgtacgaccctctccttacgcgtaccctccgaggtctagaccgtagtcggtacggtcgttaaccgttttagcgtccgttaggaccctttacggtaattacgtcggtaccgtaacgtacgtaacttaattaaagttcgtggtacgttcgggacggaacggtaaccgtaaaggtccgtaaacggtcccgtaaggttccgaaccgaacgtaacggtccgtaccggcccccgttggccctacgttcccg

SEQ ID NO: 423961 - DNA, 433 bp, Homo sapiens
  misc_feature: GZ8MTXP02IICZ8.22.46.E02.1.454.CMB.2.raw
  modified_base (391)..(391): a, c, t, g, unknown or other
  modified_base (417)..(417): a, c, t, g, unknown or other
  modified_base (421)..(433): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaaggaactcagtgtatctgcaaatgaacagcctgacagccgagacacggctgtctatactgtacgagagattggcaagcctgggccttgatgtctgggccctggacatggtcacgtctcttagcctcaccgaaggccccatccggtccttccccctggccgccctgacctccaggcgccaccctccgagacgcacagtccgccccgtggcctcgcctgtacaacggctacttccacgctacngtctggagcgggatggcaaggccganagtnnnnnnnnnnnnn

SEQ ID NO: 423962 - DNA, 749 bp, Homo sapiens
  misc_feature: GZ8MTXP02IN60M.22.46.E02.1.454.CMB.2.raw
  modified_base (233)..(233): a, c, t, g, unknown or other
  modified_base (242)..(242): a, c, t, g, unknown or other
  modified_base (253)..(253): a, c, t, g, unknown or other
  modified_base (487)..(487): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccactctcctgcacgtgggaccagcagtnatgttggtncttatactatntctctgtaccagcaccaccgaggaccaaccgcccccattctttaagttttcggtctactaaactaacccgtcccccgtcgtacggggtcccctgacttcgccttcccgtccgtctaccaagtcctcggccaacgccggtcccctcccgtacgacctactccgtccgtacggtaccttcccgaggtccttggaaccggtacgtacgggtacgggggttacttaacgtttttaccncggtaccgtcggtacttaccggtaattaccggttcgggaacccgtaacgggtaacccttaaaacgttaagttaaaaacgtttcggttaacggggtttcccggttaccgggggaacgggttaacccggggaaaaccgtaaacggggttaccggtaaaccccggtttcccgtaaaagggttcccgtaaaccggaaccccggtaaaacggggtcccttaaaccccggtcccccggtttaacgggtccctaaccgttttcccccgg

SEQ ID NO: 423963 - DNA, 533 bp, Homo sapiens
  misc_feature: GZ8MTXP02FYN0D.22.46.E02.1.454.CMB.2.raw
  modified_base (241)..(241): a, c, t, g, unknown or other
  modified_base (297)..(297): a, c, t, g, unknown or other
  modified_base (410)..(410): a, c, t, g, unknown or other
tcagacatacgcgtcacgaccggtgctcgatttagactcatctacagggaaagggggggtctcaggaggcagcactctcgggacgtctccaccatggcctgggctctgctcctcctcagccctcctcactcagggcacaggatcctgggctcagtctgccctgactcagcctcgctcagtcgtccgggtctcctggacagtccgtcaccatctcctgcacgtggaccagcagtgatgttgncttatactatgtctctgtacagcaccaccagacaacgcccccaatcttaatttgtntactaactacccgccctcgacgggtccctgactcgcttcctccgctcatctgacacgccgcctcctgaccatctctcgactccgagtctgacgtatcggaggtctactttacngtctgtctactatacgtgacacggactaaactaagtaatagtcgtacgtcggacggtacggaactaaaggcgtaaccgtcgtacgtcacgaaccgagccgtaccgcccctggtccacgtcccg

SEQ ID NO: 423964 - DNA, 458 bp, Homo sapiens
  misc_feature: GZ8MTXP02ILM47.22.46.E02.1.454.CMB.2.raw
  modified_base (342)..(342): a, c, t, g, unknown or other
  modified_base (441)..(458): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgagacacggctgtctattactgtacgagagattggcaagccgtgggtcctttgatgtcgtcggggccctggggacaagtggtcacgtctcttagcctccaccaggcccatcgtcccttcccctgcctcctgcctccaggacgccacccgtcganacgcacgcgccggcccctggctcgccgtcgacgaacggtctacctccgaacgtccttagtcgtcgtgacggcggggctgggcccaaggggcacaggtannnnnnnnnnnnnnnnnn

SEQ ID NO: 423965 - DNA, 628 bp, Homo sapiens
  misc_feature: GZ8MTXP02IVNGQ.22.46.E02.1.454.CMB.2.raw
  modified_base (248)..(248): a, c, t, g, unknown or other
  modified_base (317)..(317): a, c, t, g, unknown or other
  modified_base (458)..(458): a, c, t, g, unknown or other
tcagacatacgcgtcacgaccggtgctcgatttagactcatctacagggaaaggggggggtctcaggaggcagcactctcgggacgtctccaccatggcctgggctctgctccctcctcagcctcctcactcagggcacaggatcctgggctcagtctgccctgactcagcctcgctcagtcgtccgggtctccgtggacagtccgtccaccatcctcctgcacgtgggaccagcagtgatgttggtntacttaatactatgtctctggtacagccacccaccgagaccaaaccgcccccaattctttagtttggtntactaactacccgcccctgacgggtccctgactcgcttcccgccgctaccagtctgcacgacgtccctccgcgacctatcctcgtggtaccctccgagggtctacggacgtaagtgggtacgggttcttaaccgtttacgngtaccttcgtacttctaagttctacggacacggtactaaacgttataaagttgttcggtacgttcgggaacgggtaggaaacctaacgggtactacccggttacgtaacggtccaacggtaacccgaacggtccgtcccggtcccccgttacggtccctacccgttcccg

SEQ ID NO: 423966 - DNA, 454 bp, Homo sapiens
  misc_feature: GZ8MTXP02JB1SE.22.46.E02.1.454.CMB.2.raw
  modified_base (443)..(443): a, c, t, g, unknown or other
  modified_base (445)..(454): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagccgtgggcctttgatgtcgtcggggccctgggacaagtggtcaccgtctcttacgcctccaccgacggccccagtccggtccttccccgtggccgccctgcctccgacggcgccacccgtccgagacgcacgacggccggccccgtgggctcgccgtggaccaaggtcctactccacgcgtatcgtcgtgacggcggcgtggacgaggccactagngnnnnnnnnnn

SEQ ID NO: 423967 - DNA, 435 bp, Homo sapiens
  misc_feature: GZ8MTXP02G1L5C.22.46.E02.1.454.CMB.2.raw
  modified_base (427)..(435): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacatggtcaccgtctcttagcctccaccaaggcccatccggtccttccccctggccgcccctgcctccgaggcgccaccctccgagacgcacagccgccccctgggctcgcctggtcaaggcctactccacgtcgtatgtctgacgcgggctgggcaaggccgacatagnnnnnnnnn

SEQ ID NO: 423968 - DNA, 449 bp, Homo sapiens
  misc_feature: GZ8MTXP02F91XK.22.46.E02.1.454.CMB.2.raw
  modified_base (439)..(449): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtcgtggggccctgggacaagtggtcaccgtctcttagcctccaccaaggccccagtccggtccttccccctggccgcccctgcctccgaggacgccaccctccgagacgcacgagccggccccctgggctgcctggtcaaggcctaccgttccacgtcgtatgtctggacgcgggctgggcaaggcgacagtacgnnnnnnnnnnn

SEQ ID NO: 423969 - DNA, 485 bp, Homo sapiens
  misc_feature: GZ8MTXP02HHFEU.22.46.E02.1.454.CMB.2.raw
  modified_base (473)..(485): a, c, t, g, unknown or other
tcagacatacgcgtcacgaccggtgctcgatttagactcatctacagggaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggtcctttgatgtcgtcgggccctgggacagtggtcaccgtctcttacgcctcccacgacggccccagtccgtcccttcccccgtggccgccctgcctccgagacgccaccctccggagacgcacgacggccggccccgtcggggcctacggccgtaggtaccgaacggtcccttaccttcccgacggtaccgttattcggtaccgtggacggtcggggcctggggcgaacggcgcaagtgnnnnnnnnnnnnn

SEQ ID NO: 423970 - DNA, 470 bp, Homo sapiens
  misc_feature: GZ8MTXP02IP8VP.22.46.E02.1.454.CMB.2.raw
  modified_base (199)..(199): a, c, t, g, unknown or other
  modified_base (269)..(269): a, c, t, g, unknown or other
  modified_base (342)..(342): a, c, t, g, unknown or other
  modified_base (377)..(377): a, c, t, g, unknown or other
  modified_base (446)..(446): a, c, t, g, unknown or other
  modified_base (452)..(470): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgacaaatgaacagcctgacagccgagacacggntgtctattactgacgagagtattggcaagccgtgggtccttgatgtcgtcgggccctgggacagtcggcnccgtctcttacgccctccaacgacggccctagtccggtccccttccccgtggccgccctgcctaccgaggacncctaccctcggagacgccacgacgtccggtcccgnggcctcgccgtggtacaacgtcctacgtccacggtcttatcgctaggcggtcggctagggacgcggcanaagtgnnnnnnnnnnnnnnnnnnn

SEQ ID NO: 423971 - DNA, 577 bp, Homo sapiens
  misc_feature: GZ8MTXP02HM6ZA.22.46.E02.1.454.CMB.2.raw
  modified_base (201)..(201): a, c, t, g, unknown or other
  modified_base (251)..(251): a, c, t, g, unknown or other
  modified_base (261)..(261): a, c, t, g, unknown or other
  modified_base (273)..(274): a, c, t, g, unknown or other
  modified_base (376)..(376): a, c, t, g, unknown or other
  modified_base (389)..(389): a, c, t, g, unknown or other
tcagacatacgcgtcacgaccggtgctcgatttagactcatctacagggaaaggggggggtctcaggaggcagcactctcgggacgtctccaccatggcctgggctctgctcctcctcagccctcctcactcagggcacaggatcctgggctcagtctgccctgactcagcctcgctcagtcggtccggtctccgtggacncgtcccgtcaccatcctcctgccacgtgggaccagctagtgattggttgntcttatactntgtctctgtacnncaccaccagaccaacgccccaattctttaatttgtacgtacaacgtacccgcccgtcgacgggtcctgtactcgtcttcccgtccgactaccagtctcgacncgaccgtcctccncgtactatctacgtcgacctccgagtcctagacgtagtcggtaggttactacgtttacgtcgtacgtcgttctacgtatacgtcgacgacgactacgtaatagtggttacgtcgtacggacggtacggactacgtcgaccgttacgacgtcgacgaacgcgtccgtccgccgtcgaccgttactcccg

SEQ ID NO: 423972 - DNA, 494 bp, Homo sapiens
  misc_feature: GZ8MTXP02G2DOO.22.46.E02.1.454.CMB.2.raw
  modified_base (277)..(277): a, c, t, g, unknown or other
  modified_base (314)..(314): a, c, t, g, unknown or other
  modified_base (351)..(351): a, c, t, g, unknown or other
  modified_base (435)..(435): a, c, t, g, unknown or other
  modified_base (454)..(454): a, c, t, g, unknown or other
  modified_base (458)..(458): a, c, t, g, unknown or other
  modified_base (461)..(494): a, c, t, g, unknown or other
tcagacatacgcgtcacgaccggtgctcgatttagactcatctacagggaaaggggctggagtggatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgacgagagattggcaagccgttgggcctttgatgtcggtggggccctgggactaagtggtcaccgtntctttagcctccacgaggcccagtccgccttccccgngccgtcctcgctccgaggactcacccgtcgagcgacngacggccgcccccgtggcctcgccgttggacgaacggtcctacgttccgacgtcgtaagttccgtcggtacgaggggcccggtntacggggctaagggccganagtncgnnnnnnnnnnnnnnnnnnnnnnnnnnnnnnnnnn

SEQ ID NO: 423973 - DNA, 506 bp, Homo sapiens
  misc_feature: GZ8MTXP01D4DE6.39.50.E06.1.454.CMB.2.raw
  modified_base (204)..(204): a, c, t, g, unknown or other
  modified_base (500)..(500): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaacctggccagactcccaggctcctcatgtatggtgcgtccaccagggcccactggtatcccagccaggttccagtggcagtgggtctgggcagagttcagtctcaccatcagcagcctgcagtctgaagtatttgtactttattactggtcagtcagtatgatacctggcctcactactttggccctagggggacccagggttggagtattcgaaagaactgtggctgcacctnttcttg

SEQ ID NO: 423974 - DNA, 512 bp, Homo sapiens
  misc_feature: GZ8MTXP01D7KRG.39.50.E06.1.454.CMB.2.raw
  modified_base (205)..(205): a, c, t, g, unknown or other
  modified_base (440)..(440): a, c, t, g, unknown or other
  modified_base (453)..(453): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagactattagcagcaacttagcctggtaccagcaaaacctggccagactcccaggctcctcatgtatggtgcgtccaccgagggcccactggtatcccagccaggttccagtgcagtggtctgggcagagttcagtctcacatcagcagcctgcagtctgaagtatttgctagtttattacgtgtacaaacagttaacaatgactggcctntctacgttcgggnggtagggaccgtaaggttggagtattacgaaacgactggtggctgcacctaagttctcg

SEQ ID NO: 423975 - DNA, 641 bp, Homo sapiens
  misc_feature: GZ8MTXP01CNC86.39.50.E06.1.454.CMB.2.raw
  modified_base (284)..(284): a, c, t, g, unknown or other
  modified_base (293)..(293): a, c, t, g, unknown or other
  modified_base (297)..(297): a, c, t, g, unknown or other
  modified_base (324)..(324): a, c, t, g, unknown or other
tcagtcgcactagtcacgaccggtgctcgatttagatctactgacaacacacaaggggaggaactgctcagttaggacccagacggaaccatggaagccccagcgcagcttctcttcctcctgctactctggctcccagatatcactggagaaatagtgatgacgcagtctccagccacctctctgtgtctccaggagaaagagccacctctcctgtagggccagtcagagtgttagctacaacttgcctggtaccagcagaaactggccaggttcccaggctnatcatctanggtnctatccacgagggcctagtggtaaccnccacgtacccccttacgttaggcgacgtagggtcgggtacgtgggactaggtacgttaccactcctacacctatcgacgcacgtccgtagactacgtactaaggtaacgttagtttacgtacgtttaagttttacgttacgttacgtaacctaaacgtaacgttaaactaacgttacgtaccgtcggtacccttaccgttacgttaaccggtttcggggaaccgggttaacgggtaaaccggttaagggtacggtaacgttacgttaaacgaaaccggtaacgtacggtcggtacgtacgacctaaccgttcgttcg

SEQ ID NO: 423976 - DNA, 575 bp, Homo sapiens
  misc_feature: GZ8MTXP01E0GDI.39.50.E06.1.454.CMB.2.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagactatagcagcaacttagcctggtaccagacaaaacctggccagactcccaggcctcctcatgtatggtcgcgtcccaccgagggcccacgtggtactcccgagcccaggttcccaggtggctaggtggggtctgggcagagttcagtctcacatcagcagcctgcagtctagaagtattttgtactttattactggtactaggtctagttatcgacttaccgtaggtccctactaccgttacgttttcgggaacccggtaagggggttacccgtaggggtttggaacgtaagttaacgaaaacggttacttggtgggtcctaggtcccaactcgttccttg

SEQ ID NO: 423977 - DNA, 569 bp, Homo sapiens
  misc_feature: GZ8MTXP01E0GKL.39.50.E06.1.454.CMB.2.raw
  modified_base (204)..(204): a, c, t, g, unknown or other
  modified_base (213)..(213): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagactattagcagcaacttagcctggtaccagcaaaacctggccagactccagctcctcatgtatggtgcgtccaccagggcccactggtactcccagccaggttccaggtggcagtgggtctgggcagagttcagtctcaccatcagcagcctgcagtctgagtatttgtactttatactggtcagcagtatgatacctggtccctctactacgttttgggccccgtaagggggttaccccgtaggggtttagggaacgtaacggttaaccgaaaaccggttaacgttcggggtacgggtaaccgttgggacccttacccgtaacgtttccgtttccgg

SEQ ID NO: 423978 - DNA, 561 bp, Homo sapiens
  misc_feature: GZ8MTXP01DIUOT.39.50.E06.1.454.CMB.2.raw
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccacagggccactggtactcccagcctaccctttagtggcagtgggtctgggcagagttcactctcacatcagcagcctgcagtctagtaagtattttgcttaagttttacttacgttacggttactaaactagttaaccaaagttcgaaccttgggtcccttctctaccgttttcggggaacgggtaacggggaccgtaaagggttggaagtattaccgaaacgttacgtggtagggctgcacctaattcgttcg

SEQ ID NO: 423979 - DNA, 637 bp, Homo sapiens
  misc_feature: GZ8MTXP01AUI4L.39.50.E06.1.454.CMB.2.raw
  modified_base (243)..(243): a, c, t, g, unknown or other
  modified_base (403)..(403): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagatatcactggagaaatagtgatgacgcagtctccagcccaccctctctgtgtctccaggagaaagacgccaccctctcctggtagggccagtcagagttgtanctacaacttgcctggaccagcagaactggccaggtcccaggctcatcatctagtggtcgcactcccacgacgggccagtgtactcccacgtccccctaccgttttaggcggcgtaggttcggggtcgtggggactagggtacgttccactctacaacccntaccgaggcacgtcctgacgtacgttcgtagtaagttattttcgactttaagtttagttaactgttaaccaaacgtaagtaacaacgttacgtacgtccggtccttccgttaccgtaacgggtttccggggaacggggttaacgggtaaccggttaaagggggttaggaacgttaacgttaaccggaaaacggtaacgtgggttaacggctcggacctaaccgttaagtttccg

SEQ ID NO: 423980 - DNA, 571 bp, Homo sapiens
  misc_feature: GZ8MTXP01C2L6L.39.50.E06.1.454.CMB.2.raw
  modified_base (203)..(203): a, c, t, g, unknown or other
  modified_base (287)..(287): a, c, t, g, unknown or other
  modified_base (405)..(405): a, c, t, g, unknown or other
tcagtcgcactagtcacgaccggtgctcgatttagatctactgacaacacacaagggggaggaactgctcagttaggacccagacggaaccacggaagccccagcgcagcttctcttcctcctgctactctggctcccagataccactggagaagtagtgatgacgaagtctccagccaccctgtctgtgtctccaggggaanagccaccctctcctgcagggccagtcagactatagcagcaacttagcctggtaccagacaaaacctggccagactccagctccncatgtatggtgccgtccaccgagggcccacgtggtactcccagccaggttcaggtcggcaggtgggtctgggaacaggtgttcagtctacaccatcagcagcctgcagtctagtagtntttagtactttattactgtcagtctagtatcgtataccgtggtcctactactacgtttcggaccgtagggggtaacccgtagggttacgggaagttacgttaaaccgaaacggttaacgttcggttcgggaactggaaccctactattcttcggttcctttaaccg

SEQ ID NO: 423981 - DNA, 541 bp, Homo sapiens
  misc_feature: GZ8MTXP01ALY4J.39.50.E06.1.454.CMB.2.raw
  modified_base (302)..(302): a, c, t, g, unknown or other
  modified_base (348)..(348): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtncatcccaccgagggcccacgtggtactcccagcctacccgtttagnggcaggtgggtctgggaacagtagttcactctcaccatcagcagcctgcagtctagagtatttgcttagtttatacgtgtactaacagtacaatgactggccttctcgtacgtttcgggcggtacgggaccaaaggggttgaagtacttacgaaacgttacgtggtacggctacggcaccgtaattccgttcg

SEQ ID NO: 423982 - DNA, 586 bp, Homo sapiens
  misc_feature: GZ8MTXP01EKM2T.39.50.E06.1.454.CMB.2.raw
  modified_base (206)..(206): a, c, t, g, unknown or other
  modified_base (288)..(288): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgcccaccctctcctgcagggccagtcagactatagcagcaactgcctggtacagacaaaactgaccagactccagcctcnatgtatggtcgccgtccaccgaggccctacgtggtactcccgagccgtaggttccgaggtggacgtaggtcgggtacgtaggggaacaggtacgttcacgtctacgacatcgagcacgcctgactagtctagaagttatttgttaactttattacttggtactaaggtctaagtatgtacttccgtcgtccttctaacgttacgtttcgggaaccgtaacgggggttaccgtagggttacgggaatacgttaaacgaacgttacgtaaggtcgcgtagacccttactaacttcgttcg

SEQ ID NO: 423983 - DNA, 541 bp, Homo sapiens
  misc_feature: GZ8MTXP01BNDBR.39.50.E06.1.454.CMB.2.raw
  modified_base (205)..(205): a, c, t, g, unknown or other
  modified_base (433)..(433): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagactatagcagcaacttagcctggtaccagacaaaacctgccagactcccaggctcctcatgtatggtgccgtccaccgagggcccacgtcggtactcccagccaggttccaggtggcaggtgggtctgggcaggtagttcagtctcacatcagcagcctgcagtctagtaagtatttgtactttatactggtcagtcagtancgtatacgtgcctacactacgtttggccctaagggggttccctaggggttggaagtaacgttaccgaaacggttaaccgtgtacgggctcggcacctaattccgttcg

SEQ ID NO: 423984 - DNA, 515 bp, Homo sapiens
  misc_feature: GZ8MTXP01CY3HN.39.50.E06.1.454.CMB.2.raw
  modified_base (204)..(204): a, c, t, g, unknown or other
  modified_base (284)..(284): a, c, t, g, unknown or other
  modified_base (420)..(420): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagactatagcagcaacttagcctggtacagcaaaactgcagactcccaggctctnatgtatggtgcatccacagggccactggcactccccgacacggttcagtggcaggtgggtctgggacagacgttcactctcaccatcagcagactggagcctagaagtatttgctagtgtattactgtcagcagtntggtacgctcctaccttccaccgttcggccgaaggggaccacgacgtggaacgttagttaaacgaactagtcggactcgactaacccgaattccg

SEQ ID NO: 423985 - DNA, 616 bp, Homo sapiens
  misc_feature: GZ8MTXP01D10XD.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactatagcagcaactgcctggtaccagacaaaacctggaccagactcccagcctcctcatgtatggtgcgtccaccgagggcccacgtggtactcccgagccgaggttcccaggtgcgaggtgggtctgggcagtagttcagtctcacatcagcagcctgctagtctagtaacgttattttacgttactttaattacttaggttacgtaaggtactaaggttaatcgtaacgtttaacccgtcgggtacccttccttaacgttacccggttttcgggaacccggtaacgggggttacccgtaaggggtttcgggaagtaacgttaccgaaaacggttaaccgttggtacggaacgttcggaccaacccgttaattccgttaacg

SEQ ID NO: 423986 - DNA, 560 bp, Homo sapiens
  misc_feature: GZ8MTXP01AP66V.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactattagcagcaacttagcctggtaccagacaaaacctggaccagactcccgaggctcctcatgtatggtcgccgtccaccgagggcccacgtggtactcccgagccaggttccaggtggcgtaggtgggtcgtgggcagagttcagtctcaccatcagcacgcctgcagtctagtagtatttgtactttattactggtcagtctagtatgactaccgtggcctcgtacttacgtttcgggaaccgtagggggttaccgtagggttcggaagtaacgttacgaaaacgttacgtggtcgggtctcggaccttacctaagttcgttcg

SEQ ID NO: 423987 - DNA, 579 bp, Homo sapiens
  misc_feature: GZ8MTXP01C5UR0.39.50.E06.1.454.CMB.2.raw
  modified_base (205)..(205): a, c, t, g, unknown or other
  modified_base (359)..(359): a, c, t, g, unknown or other
  modified_base (458)..(458): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagcccacctctcctgcagggccagtcagactattagcagcaaacttagcctggtaccagacaaaacctggccagactcccaggctctcatgtatggtctccacagggccactggactcccagccaggttcagtggcaggtgggtcgtggggacnggagttcagtctcaccatcagcagcctgcagtctagtaagttattttagttactttattactgtcgtagtctagtatgaacttacccgtggtacccctntaccgttacgttttcgggcccgtaacgggggtacccttaagggggtttgggaaacgtaacgtaccgaaaaacggttcttgggtcggtaccttggaccacccttagttccttaacgtttccc

SEQ ID NO: 423988 - DNA, 635 bp, Homo sapiens
  misc_feature: GZ8MTXP01DPXQW.39.50.E06.1.454.CMB.2.raw
  modified_base (207)..(207): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaagggggaaangcccaccctctcctgcagggccagtcagactatagcagcaactgcctggtacagacaaaacctggaccagactcccaggcctctcatgtatggtgccgtccaccgagggcccacgtggtactcccagcctaggttcccaggtggctagggtcgggtcgtacgggaacgagggtagtttcgacggttcctaccaacctatccgaacgcctacggccctgacgtaaggttactagtaaaggtttatttttacgttaacttttaagttaccgttggttacgtaggttacctaaagggtttatacggtaacgttacccgtcgggtacccttactaccgtttacggttttcgggaaccggtagggggttacctaggggttacggaagtacttaacgaaacgacgtgggtacgcgtagaccacctgttcgttcg

SEQ ID NO: 423989 - DNA, 521 bp, Homo sapiens
  misc_feature: GZ8MTXP01BL7L9.39.50.E06.1.454.CMB.2.raw
  modified_base (204)..(204): a, c, t, g, unknown or other
  modified_base (214)..(214): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctntcctgcagggccagtcagactatagcagcaacttagcctggtaccagcaaaacctggccagactccagctcctcatgtatggtgcgtccaccagggcccacgtggtatcccagccaggttcccaggtggcagtgggtctgggcaggagttcacgtctcattatcagcagcctgcagtctagaagtattagctagtttatacgtgttcagctagtataatgactggtcctacggttcggacgaagggaccaagggtacgaaatacgaaacgttaacgttggttacggctgcacgtattctgttcttcc

SEQ ID NO: 423990 - DNA, 685 bp, Homo sapiens
  misc_feature: GZ8MTXP01EIFHQ.39.50.E06.1.454.CMB.2.raw
  modified_base (205)..(205): a, c, t, g, unknown or other
  modified_base (242)..(242): a, c, t, g, unknown or other
  modified_base (278)..(278): a, c, t, g, unknown or other
tcagtcgcactagtcacgaccggtgctcgatttagatctactgacaacacacaaggggggaggaactgctcagttaggacccagacggaaccatggaagccccagcgcagcttctcttcctcctgctactctggctcccagataccactggagaagtagtgatgacgcagtctccagccacctgtctgtgtctcgaaggggaaancgccacctctcctgcagggccagtcagactatagcancactacgtcgcgtacaacacaaacacgcacacgccncgctctcatgtagtcgtcgcgtaccgaccggacggccgtactacggtacgtaccacggacgtacggtacgtacggtggtacgtaggtcgggtacggacgggtaacggacgtagtcgtacgtcctaccacgtactacgacgacgacgacgacgtacgtacgtacgttacgtaacgttaagttaagttttaacgtttaacgtttaactttacggtttacgttacgttacgtaacgttaacgttaacgttagtaacgttaccgttaccgtaccgttagttacccccccccccccgttaggtttaaccgggttaccgggttacggggtacgggttacgggtaggtaaggttacgttaacgttaaacgtaacggtacggtcggtacgtcggttacgtaacgttcgttaaccg

SEQ ID NO: 423991 - DNA, 559 bp, Homo sapiens
  misc_feature: GZ8MTXP01AS2ZM.39.50.E06.1.454.CMB.2.raw
  modified_base (205)..(205): a, c, t, g, unknown or other
  modified_base (372)..(372): a, c, t, g, unknown or other
  modified_base (387)..(387): a, c, t, g, unknown or other
  modified_base (411)..(411): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagactatagcagcaactagcctggtaccagacaaaacctggccagacctcccaggcctcctcatgtatggtgccgtcccaccgagggcccagtggtactcccgagtcctaggttccaggtggcgaggtgggtctgggaacngtagtcagtctcacntcagcagcctgctagtctagaatnttgactaatttatacgtgtactaaactatttattcttatccgtactctacgtttcggcggtaacgggaactaagggttgaacgttacgtaacgaaacgttaagttggttacggtcgtacgtccaacctagttcctcgttccttaaccg

SEQ ID NO: 423992 - DNA, 553 bp, Homo sapiens
  misc_feature: GZ8MTXP01ELT9X.39.50.E06.1.454.CMB.2.raw
  modified_base (203)..(203): a, c, t, g, unknown or other
  modified_base (300)..(300): a, c, t, g, unknown or other
  modified_base (408)..(408): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagactatagcagcaacttagcctggtaccagacaaaacctggccagactcccaggctcctcatgtatggtncgtccaccagggcccacgtggtactcccagccaggttcccaggtggcaggtggggtactggggcaggtagttcagtctcaccatcagctagcctgcagtctgtaagtntttgtactttattactgggtcaggctagtatgacttccaggtccctctacgtaccgttttcgggccgtaagggggaccgtagggtttggaagtaacgttaccgaaacggaacgtggtgccgttcggccaccgtaagttcctttcg

SEQ ID NO: 423993 - DNA, 595 bp, Homo sapiens
  misc_feature: GZ8MTXP01CGY91.39.50.E06.1.454.CMB.2.raw
  modified_base (202)..(202): a, c, t, g, unknown or other
  modified_base (288)..(288): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccacctgtctgtgtctcgaggggaangccacctctcctgcagggccagtcagactatagcagcaactgcctggtaccagacaaaacctggaccagacctcccgagcctcctnatgtagtggtcgccgtaccaccgacgggccctacgtcggtactccccgagccgtaggttcccaggtcgacgtaggtgggtacgtagggaactaggtacgttcgacgtctacacagtcagcagtccgtgactagtctagtaagttatttacgttactttattactgtactagtctagtatgacttaccgtcgtactcgtacttacgtttgggaaccgtaacggggccttagggttacgaagtaacgttaacccgaacggttaaccttgggtacggtcgttagaccgttaaccgttcgttccgtttccg

SEQ ID NO: 423994 - DNA, 596 bp, Homo sapiens
  misc_feature: GZ8MTXP01C183U.39.50.E06.1.454.CMB.2.raw
  modified_base (371)..(371): a, c, t, g, unknown or other
  modified_base (460)..(460): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagactattagcagcaacttagcctggtaccaagacaaaaacctggaccagactcccaggcctcctcatgtatggtcgccgtaccaccgacgggcccacgtggtactcccagccgaggttccaggtggcgaggtggtacgngggcgagtagttcagtctacacatcagcgacgctgacagtcgtagtaagttatttgttaactttattacttggtcaggtactaggttanagtactaccgtcggtcctacgtaccttacgttttcggaacccggtagggggaccgtagggttacggaaacgtcgttaaaccgaaacggttacgtaagggttacggcgttacggacaccgttaacttcgtttaaccg

SEQ ID NO: 423995 - DNA, 651 bp, Homo sapiens
  misc_feature: GZ8MTXP01A24SH.39.50.E06.1.454.CMB.2.raw
  modified_base (204)..(204): a, c, t, g, unknown or other
  modified_base (217)..(217): a, c, t, g, unknown or other
  modified_base (272)..(272): a, c, t, g, unknown or other
  modified_base (281)..(281): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaancgcccacctctcngcagggccagtcagactatagcagcaattgctggtacagacaaaactgccagacnccagctctnatgtatggtcgccgtacccaccgacgggaccctacgtcggtactaccccgaggtcccgtaacggtttcccgaagggtcgggaccgtaaggggttcggggtaccgtagggggaaccgtaaggtacggtttcgaacgttcctacgaacctatacgaacgcgacgtcctacgcgtacgttcgtagtaagttacttttacgttactttaattacttcggttacagtcgtaagttagtacgtacgttccgtacggtccttaccgtaccgttacgttttcgggaacccggtaggggttacccgttaagggttcggaacgtaacgttaacgaaaccgttacgtggtcggtaactggtaccacgttaacttcgttccg

SEQ ID NO: 423996 - DNA, 510 bp, Homo sapiens
  misc_feature: GZ8MTXP01BO69W.39.50.E06.1.454.CMB.2.raw
  modified_base (205)..(205): a, c, t, g, unknown or other
  modified_base (214)..(214): a, c, t, g, unknown or other
  modified_base (286)..(286): a, c, t, g, unknown or other
  modified_base (349)..(349): a, c, t, g, unknown or other
  modified_base (396)..(396): a, c, t, g, unknown or other
  modified_base (425)..(425): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctntcctgcagggccagtcagactatagcagcaactagcctggtaccagcaaaacctggccagactccaggctcncatgtatggtgcgtccacgaggccacgtggtactcccagccaggttccagtggcaggtggtcngggcagtagttcagtctcacatcagcacgcctgcagtctagtaagtnttttgtactttattactggtcagcagtangatcgtgctcactactttggcctaggggacctgggttcgagtacttacgaaacgttacgtgtagggcctggccactcttcgttcg

SEQ ID NO: 423997 - DNA, 772 bp, Homo sapiens
  misc_feature: GZ8MTXP01D1ZHV.39.50.E06.1.454.CMB.2.raw
  modified_base (206)..(206): a, c, t, g, unknown or other
  modified_base (752)..(752): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccacctctcctgcagggccagtcagactattagcagctaagttagcctaggtaccaagaaccaaaaccgtcggacccaaggacctcccgaggtcctcctcatggtatggcgccgtacaccgacgggtcccacgttggtacctaccccgaggtacccgtacggtttccaagggttcggacgtagggttcgggggtaacccgtagggggcgtaaaggttacgtttaccgtaacggttccctaacccgaaacgtacgttacccaggtacccgtaacgggcccctttagaacccgttaaggggttacctttaaagggttaaaggtttaagtttttagggggttaaactttttttggttttaaccccgttgggggttaaacgtaccggtttaacttaaagggtttaaacttaaaaccgttcggtttcccgtaacccgtttcgtttaccgggtttacccgtacggggttacccggttaaccgaaaccgggttaaacgggtaccgaaagttaacgggaaacttaacggaacgttacgttaaggcgcgtancccttaatcgttctttaacg

SEQ ID NO: 423998 - DNA, 655 bp, Homo sapiens
  misc_feature: GZ8MTXP01C48E4.39.50.E06.1.454.CMB.2.raw
  modified_base (206)..(206): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaancgcccacctctcctgcagggccagtcagactatagcagcaactgcctggtaccagaacaaaacctgaccagacctccaggcctctcatgtagtggtcgccgtaccaccgaggccctacgtggtactcccgagcctaggttccccaggtcggacgtaggtcgggtacgtagggaacgagtacgttcgaacgtcctacacgactcgagtaccgacgccctggaccgaagttccgttaaggtaaactttagttttacgttaacttttaacgttccgtttagggtaccgtaaggtactaggtttaagtcgtacttacccgttcggccccttacgtaccgttacgggtttccgggaaccggtaagggggacccgttaggggttacggtaaacgtaacgttaaccgaaacggttaacgtggtacggtcttacgccttaacctaagttccttaacg

SEQ ID NO: 423999 - DNA, 578 bp, Homo sapiens
  misc_feature: GZ8MTXP01DKTT5.39.50.E06.1.454.CMB.2.raw
  modified_base (205)..(205): a, c, t, g, unknown or other
  modified_base (292)..(292): a, c, t, g, unknown or other
  modified_base (436)..(436): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccacctctcctgcagggccagtcagactattagcagcaacttagcctggtaccagacaaaacctggccagactccacggctcctnatgtatggtcgcgtccaccgaggcccacgtcggtactccagcctaggttccaggtgcaggtggtacgtgggaactagtagttcagtctacgactgtcagctagcctgcaagtctaggaatacttgacttagtttactacggttntacaacgtatactaagtcgactggtccttcctcggttaaccttcgggggcggtaaacgggaccgtaaagggttcggtaaagtacgttacgaaaacgttacggtcggttagccgttcgaccgttaccctaagttccgttaacg

SEQ ID NO: 424000 - DNA, 502 bp, Homo sapiens
  misc_feature: GZ8MTXP02FVK01.39.50.E06.1.454.CMB.2.raw
  modified_base (204)..(204): a, c, t, g, unknown or other
  modified_base (372)..(372): a, c, t, g, unknown or other
  modified_base (398)..(398): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactattagcagcaacttagcctggtaccagcaaaacctggccagactcccaggctcctcatgtatggtgcgtccaccagggcccactggtatcccagcccaggttccagtggcagtgggtctggggcagagttcagtctnaccatcagcagcctgcagctgaagtntttgtactttattactgtcagcagtatgatacctggcctcacacttttggcctagggggaccagggttggagacgtacaaacgaactgtaggctgcaccatctg

SEQ ID NO: 424001 - DNA, 507 bp, Homo sapiens
  misc_feature: GZ8MTXP02I57P0.39.50.E06.1.454.CMB.2.raw
  modified_base (204)..(204): a, c, t, g, unknown or other
  modified_base (213)..(213): a, c, t, g, unknown or other
  modified_base (299)..(299): a, c, t, g, unknown or other
  modified_base (386)..(386): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagactatagcagcaacttagcctggtaccagcaaaacctggccagactcccaggctcctcatgtatggtncgtccaccagggccactggtatcccagccaggttcccagtgcagtggtctgggcagagttcagtctcacatcagcagcctgcagtcngaagatttgctaaacttattactgtacaactaatttaattcttaatccgcttcactttcggcgagggaccaagggtcgagtatacaaacgaactgtaggcgtgacaccatcctgtacttac

SEQ ID NO: 424002 - DNA, 491 bp, Homo sapiens
  misc_feature: GZ8MTXP02IK1O3.39.50.E06.1.454.CMB.2.raw
  modified_base (204)..(204): a, c, t, g, unknown or other
  modified_base (289)..(289): a, c, t, g, unknown or other
  modified_base (433)..(433): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagactattagcagcaacttagcctggtaccagcaaaaacctggccagactccaggctccncatgtatggtgcgtccaccagggccactggtatcccagccaggttcccagtgcagtgggtctgggcagattcagtctcaccatcagcagcctgcagtctgaagtatttgtactttattactgtcagcagtatgatactggcctnactactttggccaggggccaggttggagactacaaacgactgtaggctgcaccatctg

SEQ ID NO: 424003 - DNA, 552 bp, Homo sapiens
  misc_feature: GZ8MTXP02IHY3B.39.50.E06.1.454.CMB.2.raw
  modified_base (204)..(204): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagcccaccctctcctgcagggccagtcagctatagcagcaacttagcctggtaccagcaaaaacctggaccagactcccaggctcctcatgtatggtgcgtccaccagggccactggtatcccagccaggttccagtggcagtgggtctgggcagagttcagtctcaccatcagcagcctgcagtctgaagtatttgtactttattactgtctagctagtatagtactaccgtggcccttacaccgtacttttcgggaccgtaagggggtaccctaaggggtttcggaagtaacgttacgaaaacggtaaaccttggttacggcgtacggaccacctaacgttcttcg

SEQ ID NO: 424004 - DNA, 533 bp, Homo sapiens
  misc_feature: GZ8MTXP02HJ3UB.39.50.E06.1.454.CMB.2.raw
  modified_base (204)..(204): a, c, t, g, unknown or other
  modified_base (376)..(376): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactatagcagcaacttagcctggtaccagacaaaacctggccagactcccaggctcctcatgtatggtgcgtccaccgagggcccactggtactccagccagttccagtgcagtgggtctgggcagagttcagtctcaccatcancagcctgcagtcagtaagtattttagtactttattacgtgttactagtactagtatgtataccgtggcctcactcgtttcggccgtaagggggtacctagggttacggaagtacgtacgaaaacgtacgtggtacggctacgctaccgatttcgtcg

SEQ ID NO: 424005 - DNA, 529 bp, Homo sapiens
  misc_feature: GZ8MTXP02JTEIW.39.50.E06.1.454.CMB.2.raw
  modified_base (204)..(204): a, c, t, g, unknown or other
  modified_base (440)..(440): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagactatagcagcaacttagcctggtaccagcaaaacctggccagactcccaggctcctcatgtatggtgcgtccaccagggcccactggtatcccagccaggttccagtggcaggtgggtctggggcagagttcagtctcaccatcagcagcctgcagtctagaagtatttgtactttattactgtcagcagtatgataccgtggcctnactacgtttggaccgtagggggacctagggttcggagtacgtaccgaaaacgtaacgtggtacggacgtcggaccaccgtacgtcttcg

SEQ ID NO: 424006 - DNA, 557 bp, Homo sapiens
  misc_feature: GZ8MTXP02I5UJS.39.50.E06.1.454.CMB.2.raw
  modified_base (205)..(205): a, c, t, g, unknown or other
  modified_base (301)..(301): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccacctctcctgcagggccagtcagactatagcagcaacttagcctggtaccagcaaaacctggccagactcccaggctcctcatgtactggtncgtccaccgagggccacgtggtactcccagccaggttccagtggctaggtgggtctggggcagagttcagtctcaccatcagcagcctgcagtctagaagtatttgtactttattactgtacagtcagtatagatacctggcctcactacgtttcggaccgtagggggtaccctaggggttacggaaaggtacttacccgaaaaggtaacgtaaggtacgggtaccttacggaccacccgtaattacccggtttcg

SEQ ID NO: 424007 - DNA, 547 bp, Homo sapiens
  misc_feature: GZ8MTXP02HP2U8.39.50.E06.1.454.CMB.2.raw
  modified_base (205)..(205): a, c, t, g, unknown or other
  modified_base (403)..(403): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanagccaccctctcctgcagggccagtcagactattagcagcaacttagcctggtaccagacaaaacctggccagactcccaggctcctcatgtatggtgcgtccaccagggcccactggtactcccagccaggttccagtggcaggtggtcgtgggcagagttcagtcctcacatcagcagcctgcagtctagtaagtnttttagtactttatttactgtcagctagtatgactactggcctcactacgttttcggaccgtagggggtacctaggggtttacggaagtacgtacgaaaacggtacgtaaggtcggtacgttcggactacccacttcgtttacg

SEQ ID NO: 424008 - DNA, 559 bp, Homo sapiens
  misc_feature: GZ8MTXP02I4A28.39.50.E06.1.454.CMB.2.raw
  modified_base (300)..(300): a, c, t, g, unknown or other
  modified_base (358)..(358): a, c, t, g, unknown or other
  modified_base (376)..(376): a, c, t, g, unknown or other
tcagtcgcactagtcacgaccggtgctcgatttagatctactgacaacacacaagggggaggaactgctcagttaggacccagacggaaccacggaagccccagcgcagcttctcttcctcctgctactctggctcccagataccactggagaagtagtgatgacgaagtctccagccaccctgtctgtgtctccaggggaaagagccaccctctcctgcagggccagtcagactatagcagcaacttagcctggtaccagcaaaacctggccagactcccaggctcctcatgtatggtncgtccaccagggccactggtatcccagcctaggtcagtcggcagtggtctgggacagngttcagtctcaccatcancagccctgcagtcagtagtattttgtactttatacttgtcagctagtatagataccgtggcctcgactacgtttcggaccgtaggggtacctagggtttagggagtaaacgttaccgaaaacgtaacttagggtacgggccttacgggaccgaacccctagtaccttacggttaccttttccg

SEQ ID NO: 424009 - DNA, 516 bp, Homo sapiens
  misc_feature: GZ8MTXP02ID9EM.39.50.E06.1.454.CMB.2.raw
  modified_base (203)..(203): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccacctctcctgcagggccagtcagactattagcagcaacttagcctggtaccagcaaaacctggccagactcccaggctcctcatgtatggtgcgtccaccacgggccactggtatcccagccaggttcccagtggcaggtggtctgggcgagagttcagtctcacatcagcagctgcagtctgaagtattttagtactttattacttgtctagtctagtatgtatacctgcctctactacgttttcggaccgtaggggacctagggttcggagacgtacgaaacgaacgtgtcggactcgcactatctg

SEQ ID NO: 424010 - DNA, 548 bp, Homo sapiens
  misc_feature: GZ8MTXP02JICHO.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccagtcagactattagcagcaacttagcctggtaccagcaaaaacctggccagactcccaggctcctcatgtatggtgcgtccaccaggggcccacgtggtactcccagccagttcccagtggcaggtggtctgggcagagtcgagtctcaccatcagcagcctgcagtcagtaagtattttgtactttatactgtctagctagtatagtatacgtggcctactacttacgtttggtacgtaggggtaccgtagggttacggagtacgtaaccgaaaacggtaacgtggtacgggtacttcggactacccgtaagttctttacg

SEQ ID NO: 424011 - DNA, 534 bp, Homo sapiens
  misc_feature: GZ8MTXP02JBZCW.39.50.E06.1.454.CMB.2.raw
  modified_base (204)..(204): a, c, t, g, unknown or other
  modified_base (362)..(362): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccccctctgcagggccagtcagactattagcagcaacttgcctggtaccagacaaaacctggccagacctcccaggcctcctcatgtatggtgcgtccacagggccacgtggtactcccagcccaggttcacgtggcaggtcggtctgggacnggagttcagtctcacatcagcagcctgcagtcagaagtatttagtactttattactgtactagcagtatagacttaccgtggcctcgactacgtttcggccgtaacgggggcctaggggttcgagtacgtacgaaacgactggtaacgcctagacaccgtatcgtacgttcc

SEQ ID NO: 424012 - DNA, 538 bp, Homo sapiens
  misc_feature: GZ8MTXP02GF2ZX.39.50.E06.1.454.CMB.2.raw
  modified_base (205)..(205): a, c, t, g, unknown or other
  modified_base (401)..(401): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtcctgtgtctccaggggaaanagcccaccctctcctgcagggccagtcagactattagcagcaacttagcctggtaccagcaaaacctggccagactccccaggctcctcatgtatggtgcgtccaccagggccactggtactcccagccaggttccagtgcagtgggtctgggacagagttcagtctcaccatcagcagccctgcagtctgaagtnttttgtactttattactgtcagctagtatgatactggtcctactactacgtttggccgtagggggtacctgggtttaggaagtacgtacgaaaacggtaacgtggtacgggtaccttaggccaacctactcgtttcg

SEQ ID NO: 424013 - DNA, 541 bp, Homo sapiens
  misc_feature: GZ8MTXP02GZTYT.39.50.E06.1.454.CMB.2.raw
  modified_base (206)..(206): a, c, t, g, unknown or other
  modified_base (362)..(362): a, c, t, g, unknown or other
  modified_base (408)..(408): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagactatagcagcaacttagcctggtaccagacaaaactggaccagactcccaggctcctcatgtatggtgccgtccaccgagggcccacgtggtactcccgagccgtaggttcccagtgcaggtggtcngggcagagttcagtctcaccatcagcagcctgctagtcagtaagtntttgtactttatactgtactagctagtatgactacgtgcctcactacgtttcggccgtaggggacctagggttaggacgtacgtaaccgaaacgtaacgtggtacgaccgtacgacctaacctcgtactttcg

SEQ ID NO: 424014 - DNA, 555 bp, Homo sapiens
  misc_feature: GZ8MTXP02GJ1HA.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactatagcagcaactagcctggtaccagcaaaacctggaccagactcccaggctcctcatgtatggtgccgtccaccgagggcccacgtggtactcccgagccaggttcagtgcaggtggtctggggcaggagttcgagtctcacctatcagcagctgcagtctgaagtatttgtactttattactgtcagcagtatgtatacctggcctacactacgtttcggaccgtaggggacccgtagggtttagggaacgtacgtaccgaaaacggtaaaccgtggtacgggtacgttacgacccgtaacctacgttccgtttaccgg

SEQ ID NO: 424015 - DNA, 543 bp, Homo sapiens
  misc_feature: GZ8MTXP02GHNSM.39.50.E06.1.454.CMB.2.raw
  modified_base (206)..(206): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaangcccaccctctcctgcagggccagtcagactatagcagcaacttagcctggtaccagcaaaaacctggccagactcccaggctcctcatgtatggtgcgtccaccgagggcccactggtactcccagcccaggttccagtcggcaggtgggtctggggcaggagttcagtctcaccatcagcacgcctgcagtctgaagtatttgtactttatactgtcagctagtatgtactacgtgtcctctactacgtttcggaccgtacgggggacctagggttacggagtacgtaaccgaaaacgtaacgtggtggtctacggaccaaccgtactacgttcg

SEQ ID NO: 424016 - DNA, 601 bp, Homo sapiens
  misc_feature: GZ8MTXP02G0NGU.39.50.E06.1.454.CMB.2.raw
  modified_base (207)..(207): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaancgcccaccctctcctgcagggccagtcagactatagcagctaactagcctggtaccagacaaaacctggaccagacctccaggcctcctcatgtatggtcgcgtcccacgacgggcccacgtggtactcccgagccgtaggttcccaggtcggcgaggtcgggtcgtggggacgtaggtagttcgagtcctacacctatcagcagcctgcctagtctagtaagttattttgttactttagtaccttgtacagtactaggtatcgtactaccgtggcctactacgttacgtttcggaccggtacgggggtaccttagggggttaggaacgtacgtaaccgaaaacggttaaccgtgggtacggacgttacggacctaaccgtactttcgttaccg

SEQ ID NO: 424017 - DNA, 571 bp, Homo sapiens
  misc_feature: GZ8MTXP02F8Z8K.39.50.E06.1.454.CMB.2.raw
  modified_base (184)..(184): a, c, t, g, unknown or other
  modified_base (300)..(300): a, c, t, g, unknown or other
  modified_base (411)..(411): a, c, t, g, unknown or other
tcagtcgcactagtcacgaccggtgctcgatttagatctactgacaacacacaagggggaggaactgctcagttaggacccagacggaaccatggaagccccagcccagcttctcttcctcctgctactctggctcccagataccactggagaaatagtgatgacgcagtctccagccaccctntctgtgtctccaggagaaagcgccaccctctcctggtagggccagtcagagtgttagctacacttgcctggtaccagcagaaacctggccaggtcccaggctcatcatctatggtncatcccacgacgggcccacgtcggtactccccgagccctaccgtttaggtcggctaggtgggtcgtaggggaactaggtacgttcactcctactaccatcacgcacgtccngcagtctagtaagttatttgacttagtttattacgtagtactaactagtaacatagtactcgccttcgtctacgttcgggacggtacgggaccgtagggtcggtaagacgtaacgaaacgtaacgtggtcgacgtcgtacaccgtacttcgtcgtttacc

SEQ ID NO: 424018 - DNA, 569 bp, Homo sapiens
  misc_feature: GZ8MTXP02F41IK.39.50.E06.1.454.CMB.2.raw
  modified_base (203)..(203): a, c, t, g, unknown or other
  modified_base (365)..(365): a, c, t, g, unknown or other
  modified_base (403)..(403): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagactattagcagcaacttagcctggtaccagacaaaacctggccagactcccaggcctcctcatgtatggtgccgtccaccgacgggcccacgtggtactcccagccaggttccagtggcaggtggtctgggcagngttcagtctcaccatcagcagcctgcagtctagaagtntttagtactttattactgttcagtctagttatgtactaccgtcggtccctcgtacgtacgttttcgggacccgtacgggggtacccgtaggggtttacgggaacgtaacgtaccgaaaacggtaacgtgggtcggacgttcggaccctaccgtacttccgtttacg

SEQ ID NO: 424019 - DNA, 549 bp, Homo sapiens
  misc_feature: GZ8MTXP02GRX50.39.50.E06.1.454.CMB.2.raw
  modified_base (206)..(206): a, c, t, g, unknown or other
  modified_base (304)..(304): a, c, t, g, unknown or other
tcagtcgcactagtcacgaccggtgctcgatttagatctactgacaacacacaagggggaggaactgctcagttaggacccagacggaaccatggaagccccagcccagcttctcttcctcctgctactctggctcccagataccactggagaaatagtgatgacgcagtctccagcccaccctctctgtgtctccaggagaaagngcccaccctctcctgtagggccagtcagagtgttagctacaacttagcctggtaccagcagaaacctggccaggttcccaggctcatcatctatggtncatccaccgagggcccagtggtactcccgagcctaccttagcggcaggtgggtctggggactaggacttcactctccgaccatcagcacgcctgcagtctagtaacgtatttgacttagtttatacttgtacaactagtacagtcgacgtcgcctctctacggttcggacggtacggaccgtaggtcggacgactaccgaaacgtacgtaggtcggtcgtacgaccgtactactcgttcgttacc

SEQ ID NO: 424020 - DNA, 609 bp, Homo sapiens
  misc_feature: GZ8MTXP02IX2NH.39.50.E06.1.454.CMB.2.raw
  modified_base (204)..(204): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagcctggtaccagacaaaacctggccagactcccaggcctcctcatgtatggtgccgtccaccgagggccactggtactccagccaggttccagtggcaggtggtcgtgggacaggtagttcagtcctcgaccatcagcacgtctgcacgttctagtaagttattttagttaacttttatacttgtctagtacgtagttaatcgtaacttaccgtcggtacccttaccgtaactttaccggtttttacggaccccggtaggggggttaacccgtaggggtttaggaaacgttacgttaaaccgaaaacggttaaccgtggttaccgggacttacggacccgtaacctacgtttcctttcgg

SEQ ID NO: 424021 - DNA, 607 bp, Homo sapiens
  misc_feature: GZ8MTXP02IHTW0.39.50.E06.1.454.CMB.2.raw
  modified_base (205)..(205): a, c, t, g, unknown or other
  modified_base (214)..(214): a, c, t, g, unknown or other
  modified_base (297)..(297): a, c, t, g, unknown or other
  modified_base (361)..(361): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctcncctgcaggccagtcagactatagcagcaacttgctggtacagacaaaactggaccagactcccaggcctcctcatgtatggtnccgtccaccgagggcccacgtggtactcccagcctaggttccagtgcaggtgggtcgtgggacngagttcgagttcctcgaccatcagccagcctgccagtctagaattattttgtactttattactgtacaaggtctaaggtatacgtacttacgtcggtacccttacgtaacttaccgttttacgggacccggtaagggggtaacccgttaaggggttacgggtaaacgtaacgttaaaaccgtaaaacgtaaaccggttaaggtacggtccggttacacccgtaacccgttaattacccgtttaccg

SEQ ID NO: 424022 - DNA, 538 bp, Homo sapiens
  misc_feature: GZ8MTXP02JBVG0.39.50.E06.1.454.CMB.2.raw
  modified_base (302)..(302): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtncatcccacagggcccagtggtactccccagtccctaccgtttagcggctaggtgggtctggggacagtacgttccactctcaccatcagcacgccctgccagtctagaagtattttgacttagtttattactgtacaactagtacaatgactcggtcctactctacgtttcgggacggtacgggaccaagggtcggaagtataacgaaacgaacgtggtacggctacgccacctac

SEQ ID NO: 424023 - DNA, 560 bp, Homo sapiens
  misc_feature: GZ8MTXP02G81NH.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagactattagcagcaacttagcctggtaccagacaaaacctggaccagactcccaggcctccctcatgtatggtcgcgtccaccgagggcccacgtggtactcccagccaggttccagtgcaggtggtctagggcaggtagttccactctacattactcgagcacgcctgactagtctagaaagtattagacttaagtttacttatgttacagtactaagtattaatgacgtcggtaccttaggtaccgacgtaaacgggaccaaaggggtacgaaaactacgaaaacgtacgtagtaggtctagacctacctagtccgttcttcttacc

SEQ ID NO: 424024 - DNA, 581 bp, Homo sapiens
  misc_feature: GZ8MTXP02JKHZB.39.50.E06.1.454.CMB.2.raw
  modified_base (204)..(204): a, c, t, g, unknown or other
  modified_base (288)..(288): a, c, t, g, unknown or other
  modified_base (416)..(416): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagactattagcagcaacttagctggtacagacaaaacctggccagactccaggctcctnatgtatggtgcgtccacgagggcccacgtggtactcccgagcctaggttccagtggctaggtgggtactggggacagacgtttcagtctacgacctatacagccagccctgctagtcctaggtaagtnttttacgtactttagttacctggtcctagcaggtatgactaccgtgggcctcgtactacgtttggaccgtacgggggtacctaggggttacggacgtaagttaacccgaaaacggtaaccgttggtacggtccgttacggaccctaaccctaggttactttccgg

SEQ ID NO: 424025 - DNA, 631 bp, Homo sapiens
  misc_feature: GZ8MTXP02H3UXG.39.50.E06.1.454.CMB.2.raw
  modified_base (209)..(209): a, c, t, g, unknown or other
  modified_base (300)..(300): a, c, t, g, unknown or other
tcagtcgcactagtcacgaccggtgctcgatttagatctactgacaacacacaagggggaggaactgctcagttaggacccagacggaaccatggaagcccccagcgcagcttctcttcctcctgctactctggcctcccagataccactggagaagtagtgatgacgcagtctccagcccacctgtctgtgtctccgaagggggaaanacgcccaccctctcctgcagggccagtcagactatagcagcaacttagcctaggtaccagacaaaacctggaccagacctccaggctcctnatgtatggtcgcgtccaccgagggccacgtcggtactaccccgagccgtaggtcccaggtggcagggttcgggtcgtgggactaggtacgttcgagtcctacgacctatccagccacgtcctgacctagtctaggtaagttattttcgttaactttattacttgtactagtactagttatagtaacttacgtcggtaccttaccgtaacgtttaccggtttacgggaccggtaaacgggggtaccctaggggttacgggaacgtaaacgtaaccggtaaaacgtaccggttgggtacggtacgtacggtacctaccgtactttccgttacg

SEQ ID NO: 424026 - DNA, 597 bp, Homo sapiens
  misc_feature: GZ8MTXP02IU5E7.39.50.E06.1.454.CMB.2.raw
  modified_base (203)..(203): a, c, t, g, unknown or other
  modified_base (212)..(212): a, c, t, g, unknown or other
  modified_base (216)..(216): a, c, t, g, unknown or other
  modified_base (287)..(287): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaancgccacctntccngcagggcagtcagactatgcagcaactagcctggtaccagacaaaaccgtgaccagacctccagcctcctnatgtatggtacgccgtccgaccgacggccctacgtcggtactcccgagtccgtaggtccaggtcggcgtaggtgggtcgtagggcgagtagttcagtctacgacatacagcacgctgctagtctagagttatttagttattttattactgtactagtactagttagtagtacgtaccgtacggccttacctaacgttaccgttttccgggaaccgtacggggtaccggtaggttacgggaacgttacgtaaaccgtaaacggtaacgtaacggtacggtaccgtacgaaccgtacctacgttacgtttcg

SEQ ID NO: 424027 - DNA, 600 bp, Homo sapiens
  misc_feature: GZ8MTXP02HFVVS.39.50.E06.1.454.CMB.2.raw
  modified_base (206)..(206): a, c, t, g, unknown or other
  modified_base (290)..(290): a, c, t, g, unknown or other
  modified_base (365)..(365): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaangccaccctctcctgcagggccagtcagactattagcagcaacttagcctggtaccagacaaaactggccagactccagctcctnatgtatggtgccgtccaccgagggcccacgtggtactcccgagccaggttcccagtcggcaggtggctgggcagngttcagtctcaccatcagcacgcctgccagtctagtaacgttattttacgtacttttattacttgtctaagtctaagttatacgtacgttacccgttgggtccttaccgtaaccgttacgtttttccgggaaccgtaacgggggtaccctaaggggtttacgggaacgtaacgtacgaaaaccggtacgtaaggttacggaccgttacgggaacccaccgtaatttccggtttcg

SEQ ID NO: 424028 - DNA, 638 bp, Homo sapiens
  misc_feature: GZ8MTXP02IM6ON.39.50.E06.1.454.CMB.2.raw
  modified_base (205)..(205): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaancgcccaccctctcctgcgagggccagtcagactatagcagactaacgttacgcctaggtaccaagaccaaaaaccgtggaccaacgacctccccgaggtcctcctacatgttagtggtcgccgtaccgaaccgacgggtccctacgtcggtacctccccgagcccgtaggttcccgaggtcgcgtagggttcggggtccgtagggacgtagtacggttccaacgttcctacgaacctagtaccagtcacgccctggactagtacgtagtaacgttattttacgttattttacttcgtgtactagtctagtactgtaactcgtcgtacctactacgttacgtttcggacggtacggggtacgttagggttacgaacgtacgtaaaccgtaaagtacggtcgtacgacgttacgacctacgtacgttacgttccg

SEQ ID NO: 424029 - DNA, 623 bp, Homo sapiens
  misc_feature: GZ8MTXP02JB6FE.39.50.E06.1.454.CMB.2.raw
  modified_base (205)..(205): a, c, t, g, unknown or other
  modified_base (408)..(408): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagactatagcagctaacttagcctggtaccagacaaaacctggaccagacctccaggcctcctcatgtatggtcgcgtccgaccgacggccacgtcggtactcccgacgccgtaggtcctagtggcaggttgggtcgttgggacgtaggacgttactacgtcctacgaacctattaccngaccacgccctgctagtctagtaacgttatttagtaacttttattaaccgttgttacgtagtaccgtagttagtacggtaacttacccgtgggtacccttacgttaaccgtacgttttaccggaccggtacgggggtacctagggggtttaccggaagtacgttaaccgaaaacggtaacgtggtcggactcggacctaaccgtctacgtttacg

SEQ ID NO: 424030 - DNA, 604 bp, Homo sapiens
  misc_feature: GZ8MTXP02FU7CL.39.50.E06.1.454.CMB.2.raw
  modified_base (208)..(208): a, c, t, g, unknown or other
  modified_base (439)..(439): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtctccgaaggggaaagngcccaccctctcctgcagggccagtcagactatagcagctaactagcctggtaccagacaaaactggaccagacctccagcctcctcatgtagtggtgccgtccgaccgacgggcccacgtggtactccccgagccgtaggttcccgaggtcggcgaggttcgggtcgtggggacaggtagttcgagtctacgaccactcgacgccacgcctgcgtagtcgtagtaagttntttagtactttattactgtacagtctaggttatacgtatacgtcggtacctcgtacttacgtttcggaccggtacgggggtacctaggggttacggaacgtaacgtaaccgaaacggtaacgtcggtacggtaccgtacggaccctaacgtacgttcgtttaccg

SEQ ID NO: 424031 - DNA, 583 bp, Homo sapiens
  misc_feature: GZ8MTXP02GCZJ8.39.50.E06.1.454.CMB.2.raw
  modified_base (204)..(204): a, c, t, g, unknown or other
  modified_base (281)..(281): a, c, t, g, unknown or other
  modified_base (368)..(368): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctcgaggggaaangccacctctcctgcagggccagtcagactatagcagctaatagctggtaccagacaaaactgacagactccagctcncatgtatggtgcgtccaccgaggcccacgtcggtactcccagccgtaggttccaggtgcgtaggtcgggtctagggcgagtacgttnacgtctcaccatcagcagctgcagtcgtagtaagttattttagtaacttttaattacgttgtactagtactagtatacgacttaccgtcgtacctactaacgttcgtttcggaccggtaacgggggtaccgtacggggttaggaacgtaacgtaaccgaaaacggtaacgttgggtacggtaccgttacggacctaaccgtacttacggtttccg

SEQ ID NO: 424032 - DNA, 763 bp, Homo sapiens
  misc_feature: GZ8MTXP02JYQIF.39.50.E06.1.454.CMB.2.raw
  modified_base (206)..(206): a, c, t, g, unknown or other
  modified_base (216)..(216): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagcccaccctgtctgtgtcctcgaggggaaangccaccctcncctgcagggccagtcagtactattagcagactaacttacgccgtaggtaccaagaccaaaaaccgtgaccacgacctcccgagcctcctcatgtagtggtcgccgtccaccgacgggaccctcgtcgggtactccccgacggtcccgtaaggttcccgacgggttcggggaccgttaggggttcggggttaccggtaggggaccgtaggtaacggtttccgacggttccctacgaacccgtatacccgagcccgtaacgggtccttcggcgttacggttacgtaaggttaaagtttacgtttttacgtttaaacgtttttatttaaccgttgttaccgtagtacgttaaaggtttatacggttaacttacccggtacggttcccctaacgtaccgtttacggttttcggaaccccggggtagggggtaacccgtaagggggtttacgggaaacggttaaccgtaaaccgggtaaaaccgttacggtaacgggtttaaccggtcgtttacccgggaacccttaccggttacctttcgttttaacccgg

SEQ ID NO: 424033 - DNA, 577 bp, Homo sapiens
  misc_feature: GZ8MTXP02GLZQ3.39.50.E06.1.454.CMB.2.raw
  modified_base (204)..(204): a, c, t, g, unknown or other
  modified_base (363)..(363): a, c, t, g, unknown or other
  modified_base (369)..(369): a, c, t, g, unknown or other
  modified_base (371)..(371): a, c, t, g, unknown or other
  modified_base (402)..(402): a, c, t, g, unknown or other
  modified_base (408)..(408): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanacgccaccctctcccgcagggccagtcagactattagcagcaacttagcctggtaccagacaaaacctggccagacctccaggctcctcatgtatggtcgcgtcccaccgagggccacgtggtactcccagccgtaggttcacgtggctaggtgggtcngggacngngttcagtctcacatcagtcagcctgcagtcngaagtnttttgtactttagttactgtacagtacaggttatgtaacgtacccgtggacccttcgacgttacgtttcgggacccgtaagggggacccttaggggttacgtaacgtacgtaccgtaaaacgtacgtcggtaacgtcgttacggcctaacccgtattccgttgtttccc

SEQ ID NO: 424034 - DNA, 605 bp, Homo sapiens
  misc_feature: GZ8MTXP02HPK6N.39.50.E06.1.454.CMB.2.raw
  modified_base (205)..(205): a, c, t, g, unknown or other
  modified_base (443)..(443): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagactatagcagcaacttagcctggaccagacaaaactggccagactccagctcctcatgtagtggtcgccgtccgaccgacgggccctacgtggtactcccgagtccgaggttccaggtggctaggttgggtcgtgggctaggtagttcacgtcctcaccatcagcagctgctagtctagtagttattttcgttacttttattaccgttntacgtagtctaaggttattcgtaacttaccgtcggtacccttactaccgttacgtttcgggacccgtagggggtaccctaggggtttacggaacgtacgtaaccgtaaaacggacgttaacggtcggaccgttacggacctaaccgtacgtttacgtttccg

SEQ ID NO: 424035 - DNA, 545 bp, Homo sapiens
  misc_feature: GZ8MTXP02HTNE9.39.50.E06.1.454.CMB.2.raw
  modified_base (184)..(184): a, c, t, g, unknown or other
  modified_base (205)..(205): a, c, t, g, unknown or other
  modified_base (305)..(305): a, c, t, g, unknown or other
  modified_base (417)..(417): a, c, t, g, unknown or other
  modified_base (439)..(439): a, c, t, g, unknown or other
  modified_base (530)..(530): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagatatcactggagaaatagtgatgacgcagtctccagccaccctntctgtgtctccaggagaaagngccacctctcctgtagggccagtcagtagtgttagctacaacttagctggtaccagcaagaaacctggaccaggttccccaggctacatcatctatggtncatccacgacgggccacgtgtactccacgcccctacctttagtcggactaggtgggtctggggactagacgttcacttcacaccatcagcacgcctgctagtctagaagttntttgacttaagttttatagttntacaactagtaacattgactcgccttctacgtacgtttcggacggacgggacgaagggtgacgactaacgaaaacgtaacgtggtacgtcncgaccaccgtattcg

SEQ ID NO: 424036 - DNA, 551 bp, Homo sapiens
  misc_feature: GZ8MTXP02F9JZW.39.50.E06.1.454.CMB.2.raw
  modified_base (204)..(204): a, c, t, g, unknown or other
  modified_base (284)..(284): a, c, t, g, unknown or other
  modified_base (407)..(407): a, c, t, g, unknown or other
  modified_base (442)..(442): a, c, t, g, unknown or other
tcagtcgcactagtcacgaccggtgctcgatttagatctactgacaacacacaagggggaggaactgctcagttaggacccagacggaaccatggaagccccagcgcagcttctcttcctcctgctactctggctcccagataccactggagaagtagtgatgacgcagtctccagccacctgtctgtgtctccgaggggaaancgccaccctctcctgcagggccagtcagactattgcagctaatagcctggaccagacaaaactgccagactccagctccncatgtatggtgctaccgaccgaggcccacgttggtactcccagcctaggttccagtcgcgtaggttgggtctagggactaggagttcacgtcctacacctatccaaggtcaacgctgctagtntagtaagttatttagtactttatctatcagctagntagacttcgtacgctctaactcgtttcggacgtacggggactacggttgaacgacgttaacgaaacgaacgtaaggtcggtacttacgaccctactacggtctttaccg

SEQ ID NO: 424037 - DNA, 573 bp, Homo sapiens
  misc_feature: GZ8MTXP01DZIXC.9.64.F09.1.454.CMB.2.raw
tcagtgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccggtccactcagagtatgagtacttggttggcctggtatcagcaagaaaccaagggaaacgacccctaaactcctaatctatgatcgccttacctagtttttagggaaaggttcgggggtaccccattaccgaaaggttcaggccggcaggtggatcgtagggacaagaattcactctcacatcagcagctgcagcctgatgtatttgactaacttattactcgacccaaacgcctaattaaccgttggttaacgtttccgggccgtaggggaacctaaaggtgggaatacgttacaaaccgttaagtgtcgggacttggacctaacctagttccttatccttactaacttcccgttccccg

SEQ ID NO: 424038 - DNA, 538 bp, Homo sapiens
  misc_feature: GZ8MTXP01A6R92.9.64.F09.1.454.CMB.2.raw
  modified_base (291)..(291): a, c, t, g, unknown or other
  modified_base (327)..(327): a, c, t, g, unknown or other
  modified_base (472)..(472): a, c, t, g, unknown or other
  modified_base (532)..(532): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagcactatggatgagttgggccncaggctccgagggaggcctggagtgggtggaccaanagtaaaggagatggaagtcgagaaagtcctatggtaggactcgtagtggaaagggccgaattcatcatctaccagagaacaacgaccgagtaacctccctgtactctagacaaatgaaacagcctagagagtcgaaggacacggntatgtaattattgtgttgagagaagttaaaggttgggaacagggaaccctggtcacgtcncgtaac

SEQ ID NO: 424039 - DNA, 517 bp, Homo sapiens
  misc_feature: GZ8MTXP01AIII7.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagcactattggatgagttgggtccgcaggctccgaggggaggcctggagtggggtgccaacataaaggagatggaagtgagaagtcctatgtggctctgtgaagggccgattcatcatctcagagacaacgccgagaactccctgtatctgacaaatgaacagcctgagagtacgaggacaggctatgtattatgttgtgagagagttaaaagtggggacaagggaccctggttcaaccgttcgtcc

SEQ ID NO: 424040 - DNA, 553 bp, Homo sapiens
  misc_feature: GZ8MTXP01AFO1H.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagatcaccatcacttgccggtccactcagagtatgagtacttggttggctggtatcagcagaaaccagggaaacgacccctaaactcctaatctatgatcgccttcctagtttttagggaaagttcgggggtacccatcgaaaggttcaggccggcaggtggatcgtagggacaagtaattcactctcacatcagcagcctgcagctgatgtatttgactaacttatactgacccaacgaccctaagttaaccgtggttaacgtttcccgggcccgttaggggaacctaaaggtgggaatcgttacaaacgacgtggtacggcttgcctaacattcctgtccttcaacttccgttccccg

SEQ ID NO: 424041 - DNA, 537 bp, Homo sapiens
  misc_feature: GZ8MTXP01D0MIF.9.64.F09.1.454.CMB.2.raw
  modified_base (328)..(328): a, c, t, g, unknown or other
  modified_base (364)..(364): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggtttccttgttgctattttagaaggtgtccagtgtgaggtgcagctggtggagtctggcgggaggcttggtccagccgtggggggtccctgagactctcctgtgcagcctctggattcaccttagtcactattggatgagttggtccgcaggctccgagggaaggcctggagtgggtgccaanataaaggagatggaagtgagaagtctatgtgactgngtgagggccgattcatcatctccagagacaacgaccgagaactccctagtactctagacaaatagaacaagcctagagagtcgaaggacacggctatgtaattagttgtgttgagaagaagttaaaaggttggggaaccagggaacccgtggtccaccgtccgttcctaaccg

SEQ ID NO: 424042 - DNA, 554 bp, Homo sapiens
  misc_feature: GZ8MTXP01DH1YQ.9.64.F09.1.454.CMB.2.raw
  modified_base (291)..(291): a, c, t, g, unknown or other
  modified_base (368)..(368): a, c, t, g, unknown or other
  modified_base (375)..(375): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtgagtctgcgggaggcttggtccagccgtgggggtccctgagactctcctgtgcagcctctggattcacctttagtcactattggatgagttgggtccnccaggctccgaggggaaggcctgggagtgggggtggccaaacgaagtaaaaggagataggaagtgagaagtctatgnggaactntgtgaagggcatcatcatctcagagacaacgccgaagaactccctagtactactgaacaaatacggaaacagacctagagagtccgaggaaccgacggtctatgttattaattgttgtagagagaagttaaaacggttgggacgaacgggaacctggtccaccgttctccttcgaaccg

SEQ ID NO: 424043 - DNA, 546 bp, Homo sapiens
  misc_feature: GZ8MTXP01DYZ02.9.64.F09.1.454.CMB.2.raw
  modified_base (326)..(326): a, c, t, g, unknown or other
  modified_base (388)..(388): a, c, t, g, unknown or other
  modified_base (457)..(457): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagtcactatggatgagttggtccgcaggctcgagggaggcctggagtgggtgccaanataaaggagatggaagtgagaagtctatgtaggactcgtgtgaaagggccgattcatcatcnccagagacaacgccgagaactccctagtactctagacaaatgaacagcctagagagtcgagacacggtntatgttaattgttgtgttagaagaagttaaagttaaagggcggggaaccgaacgggtaaccgtggtaccttaccgtccttcccgtaacg

SEQ ID NO: 424044 - DNA, 800 bp, Homo sapiens
  misc_feature: GZ8MTXP01CYZVT.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagatcaccatcacttgccgtccatcagagtatgagttacttggttggcctggtatcagcaagaaaccgagggaaacgcccctaaaactcctaatctatgactcgccttactagttttagggaaaacggttcgggggtacccctaagttaccgtaaaagggtttccgaacgggtccccggggtacgtaagggttcggggtaacgttccgggttaaacggggggaaacctaagggttaaaaccttttcccgtaaaccctttacccttacccgaaacccctaattacccgaaacggtcctaaacgggccccttggaccgtaacgggtccctttaggggtaactttagggttaacttttttacggaacctttaaaaccgttttaactttaaccgtaccggggtaacccctaaaaccgggtccccttaaaagtttaaacccggttcggggtttaaaccgttttttaccccgggggaccccggtttaacggggggaaacccctaaaagggttggggaaacttacgggttaaaccgtaaaacggttacgttagggtcggttacttcggactaaccctattcgttacttccttactaacttcccgtttaaccccg

SEQ ID NO: 424045 - DNA, 594 bp, Homo sapiens
  misc_feature: GZ8MTXP01CB6H5.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagatcaccatcacttcgccggtccactcagagtatgagttacttggttggcctggtatcagcaagaaaccagggaaacgacccctaaactcctaatctatgatcgccttctagttttggaaagtcggggtacccatcgtaaggttcaggtccggcaggtggatcgtaggggaacaagtaattccacttctacaccatcagcagctgcagcctgatgtatttgactaattattacgtgaccctaaccgtacctaagttaccgttaggttacttccgggcccgtagggaaacctaaaggtgggaattacggttaaacgtaaacggttacgttagggtcggttaccttcggacctaacccgtattccgttcgttaccttactaaccgttccctttaacccccg

SEQ ID NO: 424046 - DNA, 603 bp, Homo sapiens
  misc_feature: GZ8MTXP01BW8C6.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtcactcagagtatgagtacgttggttggctggtatcagacaagaaaccgagggaaacgacccctaaactcctaatctatgatcgcctactagttttagggaaacgttcggggtacccagttacgtaaggttcgacggtcccggacgtaggtggatcgtaaggggacaagtaactcacctctacacatcagcacgcctgaccagtcctagtattgtatttcgacttaactttacttactacgacccgtaaacgcctaaacttaaaccgttggttacgtttcccgggccgtaaggggaacctaaaggtcggaattacgttacgaaacggttacgtggtcgacgttcgacctaactattccgttcgtctttctaaccttcccgttaaccccg

SEQ ID NO: 424047 - DNA, 563 bp, Homo sapiens
  misc_feature: GZ8MTXP01E07C6.9.64.F09.1.454.CMB.2.raw
  modified_base (375)..(375): a, c, t, g, unknown or other
  modified_base (397)..(397): a, c, t, g, unknown or other
  modified_base (432)..(432): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggatctgcgggaggcttggtccagccgtggggggtccctgagactctcctgtgcagcctctggattcacctttagcactattggatggagttgggtccgccgaggctccgaggggaagggcctggagtggggtgacccaaacagtaaaggagatggaagtgagagtcctatgtaggactntagtgaagggcattcatcatcncagacgacacgaccgagaacctccctgtactctanacaaactagaacacgccagagacggacggaggaaccacgggtctaagtgtaattagttgtgttagagaacgaagttaaaacggttggggaacccgagggtaaccctcggtacacccgtcgttaacccgtcg

SEQ ID NO: 424048 - DNA, 563 bp, Homo sapiens
  misc_feature: GZ8MTXP01EBN7A.9.64.F09.1.454.CMB.2.raw
  modified_base (456)..(456): a, c, t, g, unknown or other
  modified_base (479)..(479): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttcctgttgctattttagaaggtgtcagtgtgaggtgcagctggtggagtcgtggcgggaggcttggtccagccgtggggggtccctgagactctcctgtgcagcctctggattcacctttagtcactatggatgaggttggccgccaggctccgaggggaaggcctgggagtgggggtgacccaaagaagtaaaggagagtggaagtgagaagtcatgtagactgtggtagagggcctattcatcatctaccagacgacaacgaccgagaacctccctgtactctagacaaagtagaaacagaccgngagaggacgaaggacgaccggtntagtgtaattattgtagttgaagtaagaaagttaaaaggttcggggaaccagggtaaccctggtaccaccgtcttccgtaaccg

SEQ ID NO: 424049 - DNA, 549 bp, Homo sapiens
  misc_feature: GZ8MTXP01DZY49.9.64.F09.1.454.CMB.2.raw
  modified_base (335)..(335): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagcactattggatgagttgggtccgcaggctccgaggggaacggcctggagtggggtgaccaanagtaaaggagagtggaagtgagaagtcctatgtggctgtgtagaagggccattcatcatctcagagacaacgccgagaacctccctgtatctgacaaatgaaacagcctgagagtacgaggacacggctatgttatttattgttgtgagaaggaagttaaaaagggtggggtaccgaagggtaacccgtgggttacctaaccggttctaacccg

SEQ ID NO: 424050 - DNA, 604 bp, Homo sapiens
  misc_feature: GZ8MTXP01EM2H6.9.64.F09.1.454.CMB.2.raw
  modified_base (362)..(362): a, c, t, g, unknown or other
  modified_base (387)..(387): a, c, t, g, unknown or other
  modified_base (391)..(391): a, c, t, g, unknown or other
  modified_base (573)..(573): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtcactcagagtatgagttacttggttggctggtatcagcaagaaaccgaagggaaacgacccctaaactcctaatctatgatgcctactattttggaaagttgggggtacccattcgaaggttcaggccggcagtggatcgtagggacngtaactcactctacaccatcagcanccgngcagtcgtagtagttagttagttacgtaacttaactttacttaccgtacgtacccgtaaaccgtaccttaaacgttaaccgttacggtttaccgtttaccgggtacccggtaagggtaaaccgtaagggtggtaacgtacgttaaacgtaaacgttacgtggtacggcgttcgacctaactnttcgttcgttccttctaaccgttcccgtccg

SEQ ID NO: 424051 - DNA, 561 bp, Homo sapiens
  misc_feature: GZ8MTXP01AFZ5N.9.64.F09.1.454.CMB.2.raw
  modified_base (268)..(268): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtccatcagagtatgagtacttggttggcctggtatcagcagaaaccagggaaacncccctaaactcctaatctatgatcgcctctagtttaggaaagtcggggtcccatcaaggttcaggccggcagtggatcgtaaggggacaagtaattcactctacacatcagcagcctgcagcctgatgtatttgactaactttattacgtacgaccaacgacctaattaacgttggttactttccggggacccttagggggtaaccctaaagggtgggtaactaggttaccaaacgttaacgtggtcggcgttgacccaactattctacgttcttactaacgttccttccccg

SEQ ID NO: 424052 - DNA, 576 bp, Homo sapiens
  misc_feature: GZ8MTXP01BOWKK.9.64.F09.1.454.CMB.2.raw
  modified_base (292)..(292): a, c, t, g, unknown or other
  modified_base (353)..(353): a, c, t, g, unknown or other
  modified_base (481)..(481): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtgggggtccctgagactctcctgtgcagcctctggattcacctttagcactattggatgagttgggtccnccaggctccgaggggaaggcctggagtgggtgccaacagtaaaggagagtgggaaaggganaacgtcctagtggtggactcgtgtggaagggccgtattcatcatctcagagacacgcgagaacctcctgtactctagaacaaagtcgaaacgacgtccgtaggacgacggtacggacggacgacggtntagtagttattgtgttgttagaagaagtaaacgtaaaagggttcggggaccgacgggtaacccgtgggtccaccggtccttccgtcgcgtccccg

SEQ ID NO: 424053 - DNA, 532 bp, Homo sapiens
  misc_feature: GZ8MTXP01E1DH0.9.64.F09.1.454.CMB.2.raw
  modified_base (440)..(440): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcggaggcttggtccagcctggggggtccctgagactctcctgtgcagcctctggattcacctttagtcactattggatgagttgggtccgccaggctccaggggaagggcctggagtgggtggccaacataaaggagatggaagtgacgaagtctatgtggaactctgtgaagggccgattcatcatctcagagacaacgccgagaactccctgtatctgcaaatggaacagcctgagngtcgaggacacgggctatgtattaattgttgtgagagaattaaaaggttggggccgaaggggacccctggtcaccggttctccttcgaaccg

SEQ ID NO: 424054 - DNA, 591 bp, Homo sapiens
  misc_feature: GZ8MTXP01C1CH5.9.64.F09.1.454.CMB.2.raw
  modified_base (326)..(326): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactattggatgagttggtccgcaggctccgagggaagggcctggaggtgggngaccaacagtaaaggaagagtggaagtgagaagtcctaatgtagggactcgtgtaggaaagggccgatcatcatctccagagacaacgacgagaactccctgtactctagacaaagtgaacaagccgtagagagtcggaaggacgagggactagtagttaattaagttggttagttaggaaggtaagaaagttaaaaaggggttcgggggaaccgaaaggggtaaccccgtgggtaccgttaacccggttcccttccgtaacccg

SEQ ID NO: 424055 - DNA, 576 bp, Homo sapiens
  misc_feature: GZ8MTXP01EE8XU.9.64.F09.1.454.CMB.2.raw
  modified_base (191)..(191): a, c, t, g, unknown or other
  modified_base (295)..(295): a, c, t, g, unknown or other
  modified_base (378)..(378): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtagganacagatcaccatcacttgccgtccactcagagtatgagttacttggttggcctggtatcagcaacgaaaccgaagggaaacgacccctaaactcctaatctatnatcgcctctagttttggaaagtcgggtccatcgaaggttcagccggcagtggatcgtaagggacaagatcactctcacatcancagctgcagtcctgtattgtatttgacttaactttaacttacgtacgtacccaacgtacccaagttaaccgttggtttacgtttacccgggaccccgttaggggaaccctaaagggtggtaactttacggaacctaaacggttaacgtggtcggcttgaccaaccttatcttacttcttactaacgttcccgttcccg

SEQ ID NO: 424056 - DNA, 536 bp, Homo sapiens
  misc_feature: GZ8MTXP01DUIXM.9.64.F09.1.454.CMB.2.raw
  modified_base (375)..(375): a, c, t, g, unknown or other
  modified_base (462)..(462): a, c, t, g, unknown or other
  modified_base (528)..(528): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttgggtccagccgtggggggtccctgagactctcctgtgcagcctctggattctaccttagtcactatggatgagttgggtccgcaggctccgagggaagggcctggagtgggtggccaaacagtaaaggaagatggaagtgagaagtcctatgtgggactcgngtgaagggccgatcatcatctcagagacaacgaccgagactccctgtatctagacaaagtgaacagcctgacgagtcgaagcacggntagtgtaattattgtgttgagagaaagttaaaggttggggaaccaagggaaccgtggtcaccgtcncctaaccg

SEQ ID NO: 424057 - DNA, 643 bp, Homo sapiens
  misc_feature: GZ8MTXP01A0YL0.9.64.F09.1.454.CMB.2.raw
  modified_base (270)..(270): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtcctccttccaccctgtctgcatctgtaggagacagatcaccatcacttgccgtcactcagagtatgagttacttggttggcctggtatcagacaagaaaccagggaacncccctaaactctaatctatgatcgcctactagtttaggaaacggtcggggtacccagtacgaaggttcgaggccggactaggtggactcgtaagggaactaagtaaacttccaacctctaccaccatacagcacgcctgcacgctgtatgtatttcgacttaactttactacgacgtacccgaaacctaccctaagttaaccgttggtttacgtttacccgggtacccgtaacgggggtaaaccctaaaagggtggtaacgttacgttaaaccgaaaacggttaccgtagggttaccggccttcggacccttaaccgtacgtttcccttaccggtttcctttacccgtaaccctttccccgtttaacccccgg

SEQ ID NO: 424058 - DNA, 567 bp, Homo sapiens
  misc_feature: GZ8MTXP01D8QBT.9.64.F09.1.454.CMB.2.raw
  modified_base (330)..(330): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttgggtccagccgtggggggtccctgagactctcctgtgcagcctctggattcacctttagcactatggatgagttggtccgcaggctccgagggaaggcctggagtgggtgcccaanataaaggagatggaagtgagaagtcctatgtaggactcgtgtagaagggccgtattcatcatctccagagacaacgccgagaactccctgtatctagacaaagtcgaaacagacctgacgagtcggaacggacgaccgggtattagtggttaatttagttggtgttagaaggaagttaaagttaaaaagggttcgggggaacctagggaaccctgggcgaccgtccttccgtaaccg

SEQ ID NO: 424059 - DNA, 594 bp, Homo sapiens
  misc_feature: GZ8MTXP01AWQKB.9.64.F09.1.454.CMB.2.raw
  modified_base (256)..(256): a, c, t, g, unknown or other
  modified_base (415)..(415): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattgggctgagctgggttttccttgttgctattttagaaggtgtccagtgtgaggtgcagctggtggagtctggcgggaggcttggtccagccgtggggggtccctgagactctctgtgcagcctntggattcacctttagcactattggatgagttgggtccgcgaggctccgaggggaacgggcctgggagtggggtgaccaacgaagtaaaggagagtggaacgtggaagagtcctagtgtggaactcgtgtaggaagggccgtattcatcatcctacaganacgaaccgcgaacgtaacctcccgtagtactctagacgaaatgaaactcgacctggaagacggacggaacggacgacgggtcttagtaaggttatttagttgttgtagaagaagaaacgttaaaagggtcggggaaccgaacgggtaacccgtgggttacctaaccggttcctaacccg

SEQ ID NO: 424060 - DNA, 606 bp, Homo sapiens
  misc_feature: GZ8MTXP01DIR12.9.64.F09.1.454.CMB.2.raw
  modified_base (376)..(376): a, c, t, g, unknown or other
  modified_base (435)..(435): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctctgattcacctttagtcactattggatgagttgggtccgccaggctaccgaggggaagggcctggaggtgggtgaccaaacaagtaaaggagataggaagtgaagaagtctatgtgaactntggtgaagggccgattcatcatcctcagagacaacgaccgagaacctccctagtactcngacaataggaacagacctgagacgtcggaggaaccgacgggtatattagttaagtttaagtttgttggtaggttaaagaaaggtaaagttaaaaacggggttcggggttaacccggaacgggtaaaccccgtgggttaccgacccggttccctaaccttcccgtaacccgg

SEQ ID NO: 424061 - DNA, 642 bp, Homo sapiens
  misc_feature: GZ8MTXP01DSA62.9.64.F09.1.454.CMB.2.raw
  modified_base (396)..(396): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggcttggtccaggccgtggggggtccctgagactctcctgtgcagcctctggattcactttagcactatggatggtaggttcgggtcccgccgaggcctaccgaagggggaacgggccgtgggaggtgggggtcggaccaaacgaagtaaagggaagagtaggaagtggaagagtctagtgtgaactntggagaagggctattcatcatctacagagacaacgcgaagacctcctagtactctagaacaaagtacgaaacgagtccgtaggacgtaggtacggaagggaaccgacgggtacttagttgttaagtttaagtttggttaggtaggaaaggtaaaggtaaaacggttaaaaaggggttcgggggaaccgtaacgggggtaaaccccgtcgggtacccgtacccggttcctcccgttcgtaaccccgg

SEQ ID NO: 424062 - DNA, 529 bp, Homo sapiens
  misc_feature: GZ8MTXP01A3USS.9.64.F09.1.454.CMB.2.raw
  modified_base (322)..(322): a, c, t, g, unknown or other
  modified_base (381)..(381): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggtttcctgttgctattttagaaggtgtccagtgtgaggtgcagctggtggagtctgcgggaggcttggtccagccgtggggggtccctgagactctcctgtgcagcctctggattcacctttagtcactatggatgagttggccgcaggctccgaggaggctggagtgggtgccaanagtaaaggagatggaagtcgagagtcatatgtggctctgtgaagggcgattcatcatcncagagacaacgccgagaactccctgtatctagacaaatgaacagcctgagagcgaggacacggtctatgtattattggttgtagagaagttaagttaaaaggtcgggacgaacgggaacccgtggttacccgtaaccgttctaacccg

SEQ ID NO: 424063 - DNA, 626 bp, Homo sapiens
  misc_feature: GZ8MTXP01C3TUV.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgttgacatccagatgacccagtctccttccaccctgtctgcatctgtaggagacagagtcaccatcacttgccggtcactcagagtatgagttacttggtggctggtatcagcaagaaaccaagggaaacgacccctaaactctaatctatgatcgccttactagttttaggaaacggttcggggtaccctagtacgaaaggttcacggtccggcgaggtggatcgtaagggacaagtatccactctacactatcagcagcctgcagctagtattgtatttacgacttaaactttacttacgtacgaccctaaacgtccctaaagttaaccgttcgggttacgttttacccggggaccccgttaagggggaaaccctaaaagggttcggaaagtttacggaaacccgaaaaacggttacgttagggttcgggacttcggacctaacctattccttacgttccttacctaacttcccgttaaccccg

SEQ ID NO: 424064 - DNA, 534 bp, Homo sapiens
  misc_feature: GZ8MTXP01EJJPF.9.64.F09.1.454.CMB.2.raw
  modified_base (411)..(411): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgcttattttagaaggtgtccagtgtgaggtgcagctggtggagtctgcgggaggcttggtccagccgtgggggtccctgagactctcctgtgcagcctctggattcacctttagcactattggatgagttgggccgcaggctccgagggacggctggagtgggtgcaacataaaggaagatggaagtggagaagtctatgtggctctgtagagggccgattcatcatctcagagacaacgccgagaactcccngtatctgacaaatgaacagcctgagagtacgaggacacggtctatgttatttattggttgtgaagagaagttaaaaggtggggaccgaaggggaaccctgggttacctaacccggttctcccg

SEQ ID NO: 424065 - DNA, 518 bp, Homo sapiens
  misc_feature: GZ8MTXP01CHZY0.9.64.F09.1.454.CMB.2.raw
  modified_base (336)..(336): a, c, t, g, unknown or other
  modified_base (356)..(356): a, c, t, g, unknown or other
  modified_base (360)..(360): a, c, t, g, unknown or other
  modified_base (484)..(484): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagcactattggatgagttgggtccgcaggctcgagggaggctggagtggtgccaagataaagganatggaagtgagagtctatgngctntggtgagggccattcatcatctcagagacaacgccgagaacctcctgtactctacgacaatagaacacggcctgagagtcgaggacacggctatgtattatgttgtagagagagttaaaagggngggacgaacgggaccgtggttcaacgttcgtccc

SEQ ID NO: 424066 - DNA, 594 bp, Homo sapiens
  misc_feature: GZ8MTXP01BZ5J4.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggagcttggtccagccgtgggggtccctgagactctcctgtgcagcctctggacttcacctttagtcactagttggatggagttcgggtccgccaggcctccgagggggaacgggcctgggaggtggggtggaccaaacaagtaaaggaagatggaacgtgaagtaagtcctagtgtgggaactcgtgtaggaacggggccgtattcatcatctcagagacaacgaccgagaacctccctgtactctacggacaaataggaaacacgcctggagaggtacgaagggtacaccgggtctaagtgttaatttagttgttggtagaagaagaaagttaaaaagggtggggaccgaacgggaccccgtggttaccctaaccgttcctcccg

SEQ ID NO: 424067 - DNA, 558 bp, Homo sapiens
  misc_feature: GZ8MTXP01B1PU3.9.64.F09.1.454.CMB.2.raw
  modified_base (257)..(257): a, c, t, g, unknown or other
  modified_base (341)..(341): a, c, t, g, unknown or other
  modified_base (416)..(416): a, c, t, g, unknown or other
  modified_base (443)..(443): a, c, t, g, unknown or other
tcagtgatacgtctcacgaccggtgctcgatttagcgcgtatacaaggggatagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggcttgggtccagccgtggggggtccctgagactctcctgtgcagcctntggattccaccttttagctactattggatgaggttgggtccgccaggatccgaggggaaggcctgggaggtggggtggaccaanaagtaaagggaagagtaggaagtgagaagtctagtgtggaactgtgtagaagggcctagttcatcactctcaganacaacgccgaagacctccctgatctanacaaatggaacagcctagagacgtcgaggacacggtctatgtattaattgttgtgagaaggaattaaaaggttgggaccgtaagggaccctggtacaccgttctccgcgtaaccg

SEQ ID NO: 424068 - DNA, 754 bp, Homo sapiens
  misc_feature: GZ8MTXP01E251V.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagtcttgggttttccttgtttgcttattttagaaggtgtccagtgtgaggtgcagcgtggtggagtcgtggcgggaggtcgttggtccgacggtccggttcggggggtccctggacgtactctccgtgtgcacgtcctcgtggtacttctacctttagtcacgttattggatggtaggtttcgggtccccgccgtaaggccgtaccggaagggggaacggggccgttagggggaggttcgggggtacggaccccaaaagtaaaggtaaaaagggaagtaagtaggggaaagttggaaaggtagtacctagtggttaacgggaaccttcgttagggtacgggaaacggggtcccgtaatttacgattacctaattcccgtaaccgaaggaacgaacccgaaaccggaaccccggaacgtaacccttccccgttagtacttaccgtagaaacctaaagggttacgaaacgtacgtaccgtaggaaggtacggtacggaacgggacctaaccgggtataagttagttaatttaagttggagttaggaaagtaacgaaaaggttaaaagggttcgggaaccgaaggtaacccgtggtacccttcgtccttccgtaaccg

SEQ ID NO: 424069 - DNA, 604 bp, Homo sapiens
  misc_feature: GZ8MTXP01B6HMU.9.64.F09.1.454.CMB.2.raw
  modified_base (299)..(299): a, c, t, g, unknown or other
  modified_base (438)..(438): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtctggcggggaggcttggtccaggccgtggggggtccctgagactctcctgtgcagcctctggattcacctttagtcactattggatgagttcgggtccnccgaggctccgaggggaaggccgtgggagtgggtgaccaacagtaaaggagagtaggaagtgagagtctagtgtggaactctggtagaagggcctattcatcatctcagacgacaacgccgaacgacctccctgtatcngacaaatcggaacagcctaggagagtcggaggacgacggtcttagtgttattaagttgttaggtagaaggtaaagtaaaggttaaaaacggggttcggggacccggtaacgggggtaaccccgttgggtaccccgtacccgttcccgtcccgttccgtaaccccgg

SEQ ID NO: 424070 - DNA, 597 bp, Homo sapiens
  misc_feature: GZ8MTXP01D93G1.9.64.F09.1.454.CMB.2.raw
  modified_base (337)..(337): a, c, t, g, unknown or other
  modified_base (380)..(380): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtcgtggcgggaggcttggtccaggccgtggggggtccctgagactctcctgtgcagcctctggacttcactttagcactattggatgtagttcggtccgcaggctccgagggaggcctggagtgggtgacccaaanagtaaaggagagtggaagtcgagaagtctagtgtaggactcgngtagaacgggcctattcatcatctaccagacgacaacgaccgaagtaacctcccgtagtactcgtagaactaaagtacgaaactacgaccgtagagacgtacggaacggacgtacggtactagttggttaattgttggtgttagaagaagttaaagttaaaacggttcggggaaccacgggtaaccctggtaccttacccgttccgttccgtaaccg

SEQ ID NO: 424071 - DNA, 659 bp, Homo sapiens
  misc_feature: GZ8MTXP01E1M25.9.64.F09.1.454.CMB.2.raw
  modified_base (402)..(402): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgctattttagaaggtgtccagtgtgaggtgcagctggtggagtctgcgggagcttggtccagccgtggggggtccctgagactctcctgtgcagcctcgtggtattccaccttttagccactattggatggtaggttcgggtcccgccaggcctccggaggggagggcctgggaggtgggtacggacccaaacgaagtaaaggaagagtagggaagtgaagagtcctagtgtaggactcgtggngaagggtccgtattcatcatcctaccgagacgaccaacgccacgtaacctcccgtagactcagacaaagtcgaaactgaccgtaggacgaggtaccggaacggaccgaccggtattagttagttaagtttagttaggttggacggaaaggtaaaggttaaaacggttaaaacggggttcccgggggtaacccgaacccgggggtaaccccgtttacggggtaccccttaaccccggttccccgttccccgtaacccg

SEQ ID NO: 424072 - DNA, 662 bp, Homo sapiens
  misc_feature: GZ8MTXP01EA2GV.9.64.F09.1.454.CMB.2.raw
  modified_base (538)..(538): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagcttgggttttccttgttgctattttagaaggtgtcagtgtgaggtgcagctggtggagtctggcggggaggcttggtccaggccgtggggggtccctgacgactctcctgtgcagcctctggattcctactttagcactattggatggtaggttcgggtccgccgaggcctaccggagggggaacggtccgtgggagggtcgggtacggaccaaagaagtaaagggagagtaggggaaagggagtaacgtctaagtggtacggtaactcgtggtggaaacggggccctatttacatcaatcctaccaagaacaaccgaacgaccgaataaccctcctagactcagaactaaatcaaacgcgtactagacgtacgacgacggaacgacggacttaaggtnttattagtaaggttaggaggtaaagggaaagtaaaacggtaaaacggggcggggaccggaaacgggtaacccgtgggtaaccccgtaacccgttccgttaccttaaccgaacggtaaccccccg

SEQ ID NO: 424073 - DNA, 706 bp, Homo sapiens
  misc_feature: GZ8MTXP01B2Q4N.9.64.F09.1.454.CMB.2.raw
  modified_base (264)..(264): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtcgtggcggggaggtcgttgggtccaggtcccggttggggggtccctgacgacctctcctgtgcngcctgtgtattctactttgcactatggatgtagttcggtccgcgagctccgaggggacggtccgtggaggtgggtcggaccaaagaagtaaaagggaagagtaggaaagtgaacgtaagtctagtggtggtaactcgtggtaggaaacgggtcccgaatttcgatcactacctacgaaggaacgaaccaaaccggacccgaaacgtaaacccttcccctagtacttcgtagaactaaaacgtacggaaacgacgtacccgtaggaacgtaacggtacggaacggaaccgtacgggtaccttaagttagtttaagtttaagtttggttagtacggaaagtaaaggtaaaacggttaaaaacggggttcggggaaacccggtaaacggggtaaaccccgttcgggttacccgacccggtttaccgtaaccccgttcgaaccccg

SEQ ID NO: 424074 - DNA, 593 bp, Homo sapiens
  misc_feature: GZ8MTXP01ARDXM.9.64.F09.1.454.CMB.2.raw
  modified_base (460)..(460): a, c, t, g, unknown or other
  modified_base (490)..(490): a, c, t, g, unknown or other
  modified_base (536)..(536): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggcttggtccagccgtggggggtccctgagactctcctgtgcagcctctggattcacctttagcactattggatgagttcgggtccgccgaggctccgagggggaaggccgtgggaggtgggtcggaccaaacgaagtaaaagggaagagtagggaaagtgaacgaacgtctaagtgtggaactcgtgtaggaaacggggcccgtatttcatcatcctcagacgaacaaccgccgaagaacctccctagtancttagacaaatcggaaacaggccctagagngtacgaaggaccacggctagtgtattaagtgttgtagagaagtaanaaaagggttcgggaccaacggggtaccctggtaccgaccgttctcccgttcgaaccg

SEQ ID NO: 424075 - DNA, 708 bp, Homo sapiens
  misc_feature: GZ8MTXP01EX2LB.9.64.F09.1.454.CMB.2.raw
  modified_base (569)..(569): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggtttttccttgttgcttattttagaaggtgtccagtgtgaggtgcagcgtggtggagtcgtggcgggaggtcttggccaggtcccggttggggggtcccctgacgtacctctcctgtgcacgtcctctggtacttctacctttagtcacttagtggatgtacggttcggtcccgccaacgggcctaccggaaggggaacgggtccgtgggggaacggttcgggggtacgaaccccaaaagtaaagggtaaaaggaagtaagtagggaaacggttacggaaaggtaaacggttccttaaggtggttaacggtaacgtcgtagggtaagggaaacgggtcccgtaattcgatactaactcgtaccaaggaacaaccgaaccgaccgtaacgaaccttcccgtatactacgtagaacaaaggggtnaaacgtcgaccgtaggagacggtcgaaggaccgtacgtatatgttaattagttgaggttacgaagtaagttaaacgttaaacggggttcgggaaccgaacggtaaccgtcgggtaccttacgtccttaaccgtaacccg

SEQ ID NO: 424076 - DNA, 627 bp, Homo sapiens
  misc_feature: GZ8MTXP01BTKR6.9.64.F09.1.454.CMB.2.raw
  modified_base (270)..(270): a, c, t, g, unknown or other
  modified_base (482)..(482): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggtttttccttgttgcttattttagaaggtgtccagtgtgaggtgcagcgtgggtggagttcgtggcggggaggtctttgggtccaggccggttggggggtccctgagactctctgtgcagcctntggattctacctttgcatattggatggtaggttggccgcgaggcctccgagggggacggccgtggaggtgggtcggaccaaagaagtaaaggaagagtaggaagtgagaagtctatggtagacctgtggtaggacgggtcctattcgatccattctaccgagacgaaccacgaccggaacacctcctgtatctagacctaaagtcgaaacgngaccgtagaacggacgtacggaaggactaccggtattagttagttaatttgtttggtgttaggaaagtaaagttaaaggttaaaacggggttcggggaaccgtaacgggaacccgtttggcccgttacccttcgttccctaaccg

SEQ ID NO: 424077 - DNA, 621 bp, Homo sapiens
  misc_feature: GZ8MTXP01DGS02.9.64.F09.1.454.CMB.2.raw
  modified_base (513)..(513): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtcgtggcgggaggcttgggtccaggccgtggggggtccctggagactctcctgtgcagcctcgtggattcacctttagtcactagtggatgtaggttcgggtccgcaggcctccgaaggggaacgggccgtgggaggtgggggtcggacccaaacgaagtaaaaggaagagtagggaaagtcggaagaagttcctagtgtaggactcgtagtaggaaagggtcctagtcatctactctaccagacgaacgaaccgaccgtaacgaacctcccgtgttaactctagacctaaagtacgaacagacctagacgngtacgaaggacacggatagtgttaattagttgtgttagagtaagaagttaaaagggacgggggtccaaacgggtaacccgttggccgttaccgtccttccgtaacccg

SEQ ID NO: 424078 - DNA, 676 bp, Homo sapiens
  misc_feature: GZ8MTXP01DN89Y.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctgggtggagtcgtggcgggaggcttggtccaggccgtgggggtccctgagctctcctgtgcagcctctggattcacctttagtcactattggatggagttcgggtccgcaggctaccgagggaaggccgtggagtgggtggaccaaagaagtaaaggaagagtaggaagtacgagaagtcctagtgtaggactcgtagtaggaaggggcctattcatcatctacagagaaccaacgaccgaagtaacctccctagtactctagaacaaagtacgaaacgacgtaccaggaacgacggtaccggaaacgggaaccgtaccgggtacttaagttggtttaaatttaagtttgggttaggttaggaaaaggtaaaggttaaaaacggttaaaaaagggggttcggggggaaaccccgtaaaacgggggtaaccccgttcggggttaccccgttaaccccgggtttccttaaccccgttaaccccgg

SEQ ID NO: 424079 - DNA, 638 bp, Homo sapiens
  misc_feature: GZ8MTXP01BI04N.9.64.F09.1.454.CMB.2.raw
  modified_base (252)..(252): a, c, t, g, unknown or other
  modified_base (331)..(331): a, c, t, g, unknown or other
  modified_base (343)..(343): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgcttattttagaaggtgtccagtgtgaggtgcagcgtggtggagtctggcgggaggcttggtccagccgtgggggtccctgagactctctgtgcngcctctggattcactttagtcactattggatgagttgggtccgcaggctccgaggggaggcctggagtgggtgaccaanagtaaaggaganggaagtgagagtcctatgtagactcgtgtagggaacgggccgtatttacaagttcaattctaccgagacgaaccaacggacccgtaacgaacctcccgtgttactcgtagacctaaagtcgaaacgacgaccgtagacgacggtcggaacgggactacgggtctaagttggttaatttgtttggtaggttaggaaaggtaacggttaaaagttaaaaaggggttccgggggaaccggtaacccggggtaacccgttacgggtaccgttaccccgggttccttcccgttaaccccg

SEQ ID NO: 424080 - DNA, 647 bp, Homo sapiens
  misc_feature: GZ8MTXP01EESMX.9.64.F09.1.454.CMB.2.raw
  modified_base (276)..(276): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagcttgggttttccttgttgctattttagaaggtgtccagtgtgaggtgcagcgtgggtggagtcgtggcggggaggtcgtttggtccaggcccgttgggggggtcccctggacgtactctccgtgtgcagtcctntggtattcacctttagctactattggatggagttggtccgcaggctccgaggggacggcgtgggaggtggggtcgaccaaagaagtaaaaggagagtaggaagtgaagaacgtcctaagtggtggaacctgtggtaggacggggacccgtattcatcatcctaccagacgacgaaaccgccgaactacctcccgttgtactcgtagaactaaatacgaacacgtaccgtagaggacggtaccggaaggaacgtaccgggtattagtaagttaatttagtttggttagtagtaaggttaaaggaaaggttaaaaaggggtcggggtaacgaaccggggtaaacccgtgggcccgtaaccggttcctaacccg

SEQ ID NO: 424081 - DNA, 538 bp, Homo sapiens
  misc_feature: GZ8MTXP01B57ZE.9.64.F09.1.454.CMB.2.raw
  modified_base (307)..(307): a, c, t, g, unknown or other
  modified_base (496)..(496): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggagcttggtccagccgtgggggtccctgagctctcctgtgcagcctctggattcacctttagtcactattggatgagttggtccgcaggctcgaggaggcnggagtgggtgccaacagtaaaggagagtggaagtggagaagtcctagtgtgggactcgtgtgaagggccgattcatcatctccagagacaacgaccgacgaactcctgtatctgacaaagtgaacagcctagagagtacgaggacacggtctaattgtaattattggtgttgagaagaagttaaaaggnggggtaaccgagggaacccgtggtccaccgtccttccgtccg

SEQ ID NO: 424082 - DNA, 700 bp, Homo sapiens
  misc_feature: GZ8MTXP01COJJO.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtcgtggcggggaggtcttgggtcccaggccggttcggggggtccctggacgactctcctgtcgcacgcccttcgtggtactttcctacctttagtcacttattggatggtaggttcgggtcccgccgaggcctaccggaaggggaacgggccgtagggaggtggggtacggacccaaagaagtaaaaggaagagtaggaagtggaagtaaagtccgtagtggtaacgggtacttcgtaggtagggaacgggtccgtattacgatccattcctaccgaaggagaaccgaaaccgccgaacgtaaccctcccgtagtactacgtagaactaaagtcgaaacgacgaccgtaggaagacggtaacggaacggacgtaccgggtattagtgtttaatttagttggttaggagaaaggtaaggttaaaaggttaaaacggggttcgggggaacccgtacgggtaaccccgttgggtaccccttaccggttccttcccgtaaccg

SEQ ID NO: 424083 - DNA, 730 bp, Homo sapiens
  misc_feature: GZ8MTXP01EJIB2.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttatttagaaggtgtccagtgtgaggtgcagcgtgggtggagtcgtggcgggagtacttgggtcccaggtcccggtcggggggtccctggacgtacttctccgtgtcgcacgtccttgtggtacttcctacttagtctacttagtggtatggtacggttcggtcccgacgacggtccgtacggggaaggggacgggtccgtaggggaggttcgggggtacgaaacccaaaaggtaaaggtaaaaggggaaagtagtaaggggtaaaggtacggaaacggtaacgttacgttagtcgggtaacgtacctggtagggtaacgggaacggggtacctattacgaatacgtaccttacgaccgaaggaacgaaccgttaccgaacggtaactaacctccgtagtactactagaaacaagtaggaaacctgccgtaaggaacgtggacgaaacgggccgtagttattaagttgttaaattttggttgggtattaggaaagtaaagttaaaaccggttaaagggttcccgggtaacggaacggtaacccgtgggtacccttccgtccttcgaaccg

SEQ ID NO: 424084 - DNA, 642 bp, Homo sapiens
  misc_feature: GZ8MTXP01DL8UQ.9.64.F09.1.454.CMB.2.raw
  modified_base (260)..(260): a, c, t, g, unknown or other
  modified_base (335)..(335): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctgggtggagtcgtggcgggaggtcttggtccaggccgtgggggtccctgagctctctgtgcagcctntggattcacctttagcactatggatgagttcggtccgcaggctccgagggaaggccgtggagtgggtgcccaaanagtaaaggagagtggaagtgagtagtcctagtgtaggactcgtggtaggaaacggggcctattcatcatctacagagacaacgccgagaacctccctagtactcgtagaccaaagtcgaaacacgtacccgtaggaacggtacgtcggaaacgggacgtacgggtacttaagttggttaatttaagtttggttaggttaggtaaaggtaacggttaaaagggttaaaaacgggttccgggggaaccggtaaccgggggtaaccccgttggggtaccccgttacccgggttccttccccgtaacccgg

SEQ ID NO: 424085 - DNA, 685 bp, Homo sapiens
  misc_feature: GZ8MTXP01EUS8H.9.64.F09.1.454.CMB.2.raw
  modified_base (264)..(264): a, c, t, g, unknown or other
  modified_base (310)..(310): a, c, t, g, unknown or other
  modified_base (347)..(347): a, c, t, g, unknown or other
  modified_base (356)..(356): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctgggtggagtcgtggcggggaggcttgggtccaggtccggtggggggtccctggagacctctcctggtgcngccctgtggattcactttagcactattggatggaggttcgggtccnccgaggctccggaagggacgggtcctgggagtggggngacccaaanaagtaaaaggagagaggaagtgagaatctagtgtagactgtgtaggacgggcgtatcatcatctcaagacgacaacggaccaagaccctcccgtagtactccgtagaactaaaacgtcggaaactacggaccgtagaacggacggtacggaaacgggtaccgtaacgggtacttaagttggttaatttaggttggttaggttaggaaagggtaaaacgttaaaaagggtttaaaaacggggccgggggaaccccggggtaaacggggtaaaccccccgtttggggtaaccccgttaccccgggtttaacctttccccgggtaaaccccg

SEQ ID NO: 424086 - DNA, 624 bp, Homo sapiens
  misc_feature: GZ8MTXP01AX1LU.9.64.F09.1.454.CMB.2.raw
  modified_base (257)..(257): a, c, t, g, unknown or other
  modified_base (549)..(549): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgcttattttagaaggtgtccagtgtgaggtgcagctggtggagtctggcgggaggcttggtccaggccgtggggggtccctgagactctcctgtgcagcctntggattctaccttagctactatggatggtagttcgggtccgccgaggcctaccggagggggaacggtccgtgggaggtggggtacggacccaaagaagtaaaagggagtagtaggaaagtcgaagtaagtacctagtcggtacggtaaacttcgtggtacgggaaacggggtccctaattcatcaactccgtacaacggacgtaacaaccggaccgaacgtaaccctcctagtattccagaactaaagcgggaacaggcctaggagacgtacggagaccgacggtatagttntattaagttgagtagaagacgaaagttaaagggcgggacctaagggaccctggtcacccgttctccgttcgcccg

SEQ ID NO: 424087 - DNA, 794 bp, Homo sapiens
  misc_feature: GZ8MTXP01DSN2X.9.64.F09.1.454.CMB.2.raw
tcagtgatacgtctcacgaccggtgctcgatttagcgcgtatacaagggggagagaggagccttagccctggactcaaaggcctttccacttggtgatcagcactgagaacagaggactcaccatggaagttggggctgagtcgttgggtttttccttgttgtcttattttagaggtgtcagtgtgaggtgcagcgtgggtggaggtcgtgggcggggtaggtcgtttcgggtccgacgggtcccgggttggggggttcccctaggtacgtaccttccgttccgtggtcgaccgacgtcccgttcgttaggtactttaccttaaccttttagtactacgttagttggagttggtacgggttcgggtccccgaccggtaggtcccgtaccgggaaggggggtaccggtccgggttagggggtagggttacgggggacggaaacccgaaaagtaaaaggtaaaggggaagtaaggtaagggaagtacggtaaacgtacgttacgtagtggtacggtaacttgtgggtagggaaccggtactattacactcaactcctacgaagaacgaaccgaaccggaccgtaaacgtacccttccgttagtacctacgtaacaaacgtaaacgtaacggaaacgtaggaccggttaaggaacgtaaggtaccggaaggaaccgtaggttattagtttagttagttaagttggttagtagaaaggtaaaacgtaaagggttaaacgggcggaaacccggtaacggtaccgttcgggccctaccgttccttaaccgccgtaacccg

SEQ ID NO: 424088 - DNA, 914 bp, Homo sapiens
  misc_feature: GZ8MTXP01C3982.9.64.F09.1.454.CMB.2.raw
  modified_base (191)..(191): a, c, t, g, unknown or other
  modified_base (665)..(670): a, c, t, g, unknown or other
  modified_base (901)..(914): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtagganacagatcaccatcacttgccgtcactcagagtatgagttacgttggtggctggtatcagacaagaaaccgagggaaacacccctaaactcctaatctatgatcgtcccttacgtagttttagggaaacggtttcgggggtacccctaagttaccgtaaagggtttccgaacggggtccccggggtaccgtaagggttacgggggtaaacgtttacccggggttaaacggggggaaacccttaaggggttaaaacccttttttacccccgtaaaccccgttttaacccccgttaacccccgtaaaacccccccgttaaacgtttaaccccggaaacggggtaaccccctaaaccggggtccccccggttttaacggggaacccccgttaaaacccggggttcccccggtttttaaagggggttaaacccttttttaacgggggttttaaaaccgtttttttttttaaacccgggnnnnnnaaaaaaccccggggtttaaaccccccctttaaaaaacggttttttaaaaacccccgggggttttaaccggggggttttttaaaaccccggtttttttttaacccccccgggggggggaaacccccccggttttttaaaaccgggggggggaaaaaaaccccccgtttaaaaaaaaacggggggttttccgggggtttaaaaaacccggtttttaaaccggggttaaaaaannnnnnnnnnnnnn

SEQ ID NO: 424089 - DNA, 613 bp, Homo sapiens
  misc_feature: GZ8MTXP01BZ1AF.9.64.F09.1.454.CMB.2.raw
  modified_base (257)..(257): a, c, t, g, unknown or other
  modified_base (434)..(434): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattgggctgagctgggttttccttgttgctattttagaaggtgtccagtgtgaggtgcagctggtggagtctggcgggaggcttggtacagccgtggggggtccctgagactctcctgtgcagcctntggattcacctttagcacttattggatggtagttcgggtccgccgaggctccgaggggaacgggcctgggagtgggggtcgaccaaacgagtaaaggaagtagtaggaacgtgaagagtcctagtaggtgctacgtgtagggaacgggctagtcatcatctcagagacaacgccganaccgtcctgtactctacgacaaatagaacacgccgtaggagacggtacggacggtaacacgggtctaagtaaggttaattagtttgttaggttaggaaggttaaacggaaagttaaaaggggcgggggaaccgaacggggtaaacccgttgggttaccctaacccggttctaaccccgg

SEQ ID NO: 424090 - DNA, 655 bp, Homo sapiens
  misc_feature: GZ8MTXP01A5VTX.9.64.F09.1.454.CMB.2.raw
  modified_base (256)..(256): a, c, t, g, unknown or other
  modified_base (291)..(291): a, c, t, g, unknown or other
  modified_base (354)..(354): a, c, t, g, unknown or other
  modified_base (361)..(361): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttcctgttgctattttagaaggtgtccagtgtgaggtgcagctggtggagtctggcgggagcttggtccagccgtggggggtccctggagactctcctgtgcagcctntggattcacctttagcactatgatgagttggtccncgaggctcgagggaggctggagtgggtgacaagataaaggagataggatgagagtcctagtgngactcgngtacgaagggccattcgactcacttcaccgaagacgaacaacgccgaacgtaacctcccgtagtactctaacgtacgtaaaacgtacgaaacgtagacccgttagaacggtacggtaccggaaacgggaccgtaacccgggtactttaaagttgggtttaaatttacgtttagggtaggttacggtaaaggaaaaccggaaaggttaaaaaacgggttcgggggtaacccgaaccggggtaaaccccgtttggggaaccccttacccgggtaacccttaaccccggttaacccg

SEQ ID NO: 424091 - DNA, 478 bp, Homo sapiens
  misc_feature: GZ8MTXP02H66T5.9.64.F09.1.454.CMB.2.raw
  modified_base (343)..(343): a, c, t, g, unknown or other
  modified_base (393)..(393): a, c, t, g, unknown or other
tcagtgatacgtctcacgaccggtgctcgatttagcgcgtatacaagggggagtcagactcagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccggtcactcagagtatgagtacttggtggcctggtatcagcagaaaccagggaaagcccctaaactcctaatctatgatgcctcattttggaaagtggggtccatcaaggttcagccggcagtgatctgggacngaattcactctcaccatcagcagcctgcagcctgatgatttgacaacttnttactgcaacgccatactgtatttcggcctggaccaagtgatgtcaaacgactgtacgctgcaaccatctgtcttcactctcccg

SEQ ID NO: 424092 - DNA, 516 bp, Homo sapiens
  misc_feature: GZ8MTXP02F7D6H.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctgggggtccctgagactctcctgtgcagcctctggattcacctttagtcactattggatgagttgggtccgccaggctccagggaaggcctggagtgggtggccaacataaaggagatggaagtgagaagtctatgtggactctgtgaagggccgattcatcatctccagagacaacgccgagaactccctgtatctgcaaatgaacagcctgacgagtcgaggacacggctatgtattattgtgtgagagaataaaagtggggaaccgagggaaccctggtcacgtctcctcg

SEQ ID NO: 424093 - DNA, 517 bp, Homo sapiens
  misc_feature: GZ8MTXP02HFW65.9.64.F09.1.454.CMB.2.raw
  modified_base (515)..(515): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcgtggtttcctgttgctatttagaaggtgtccagtgtgaggtgcagctggtggagtctgcgggaggcttggtccagcctggggggtccctgagactctcctgtgcagcctctggattcacctttagtcactattggatgagttgggtccgccaggctccagggaagggcctggagtggggtggcccaaacataaaggaagatggaagtgagaagtcctatgtggactctgtgaaagggccgattcatcatctccagagacaacgccgagaactccctgtatctgcaaatgaacagcctagagagtcgaggacacggctatgtattattgtgtgagagataaaagtgggccgaggaaccctggtcaccgtctccncg

SEQ ID NO: 424094 - DNA, 518 bp, Homo sapiens
  misc_feature: GZ8MTXP02HK9OK.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactattggatgagttgggtccgccaggctccaggggaagggcctggagtgggtggccaacataaaggagatggaagtgagaagtcctatgtggactctgtgaagggccgattcatcatctccagagacaacgccgagaactccctgtatctgacaaatgaacagcctgacgagtcgaggacacggctagtgtattatgtgtgagagataaaagtgggacgaaggacctggtcaccgtctctcaccg

SEQ ID NO: 424095 - DNA, 530 bp, Homo sapiens
  misc_feature: GZ8MTXP02GZ1PA.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgcaggctccagggaagggcctggagtggggtggccaaacataaaaggaagatggaaagggagaagtcctatgtggactctgtgaagggccgattcatcatctcagagacaacgcgagaactccctgtatctagacaaaatgaaacagcctagagagcgagacgacggctatgtattattgtagtgagagaataaaaggtcgggacgaagggaacctggtacaccgtctcctacacgccc

SEQ ID NO: 424096 - DNA, 504 bp, Homo sapiens
  misc_feature: GZ8MTXP02IJGRF.9.64.F09.1.454.CMB.2.raw
  modified_base (342)..(342): a, c, t, g, unknown or other
tcagtgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggtggcctggtatcagcagaaaccaggaaagcccctaaactcctaatctatgatgcctctattttggaaagtgggtccatcaaggtcagccgcagtgatctgggacngaattcactctcacatcagcagcctgcagcctgatgattttgctaaactttattactcgacaacgcctaataacctggtactttcggccctagggaaccaaagtgactacgtacaaaacgaactggtcgctgacaacctatctcgtcttcacttcctccccg

SEQ ID NO: 424097 - DNA, 581 bp, Homo sapiens
  misc_feature: GZ8MTXP02JFJ7K.9.64.F09.1.454.CMB.2.raw
  modified_base (265)..(265): a, c, t, g, unknown or other
  modified_base (272)..(272): a, c, t, g, unknown or other
  modified_base (284)..(284): a, c, t, g, unknown or other
  modified_base (287)..(287): a, c, t, g, unknown or other
  modified_base (298)..(298): a, c, t, g, unknown or other
  modified_base (301)..(301): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagcggtggtttcgtgtaggctatttagaaggtgtccagtgtgaggtgcagctggtggagtctgcgggaggcttggtccagcctggggggtccctgagctctcctgtgcagctctggatcaccttatcntatggtntgagtggtcgcngcncgaggaggcgnggngtggtggacacaagaagaagagtagagtagagagtactatgtgactcgtgtaggaggacgtatactatacatctacagagacaacgaccgacgacctacctacgtactctagacaaatacgaacgacgacgtacgagacgacggacggacgacggacgtagtagttaagtttagttagttaggtaggtaaaggtaaaggtaaagtaaaaacgggtaacggggaaccggaaccgggtaaccggtaccggtaccgtacccgtaccgttaccgtaccgtaccg

SEQ ID NO: 424098 - DNA, 493 bp, Homo sapiens
  misc_feature: GZ8MTXP02HY0AR.9.64.F09.1.454.CMB.2.raw
  modified_base (342)..(342): a, c, t, g, unknown or other
tcagtgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaagcccctaaatcctaatctatgatgcctccatttggaaagtggggtccatcaaggtcagcgcagtgatctgggacngaattcactctcaccatcagcagcctgcagcctgatgatttgctaacttattactgaccaacgccaataactggtatttccggccttggggaaccaaaagtggatagtacaaaacgactgtacgctagcaaccatctgtctcactctcccg

SEQ ID NO: 424099 - DNA, 516 bp, Homo sapiens
  misc_feature: GZ8MTXP02GN6T6.9.64.F09.1.454.CMB.2.raw
  modified_base (497)..(497): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttggtccgccaggctccaggggaaggcctggagtgggtggccaacataaaggagatggaagtgagaagtcctatgtggactctgtgaagggccgattcatcatctccagagacaacgccgagaactccctgtatctgacaaatgaacagcctagagagtcgaggacacggctagtgtattatgtgtgagagataaaagtgggacaagggacccnggtcaccgtctccgtcacg

SEQ ID NO: 424100 - DNA, 540 bp, Homo sapiens
  misc_feature: GZ8MTXP02FR3TX.9.64.F09.1.454.CMB.2.raw
  modified_base (408)..(408): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtgggggtccctgagactctcctgtgcagcctctggattcacctttagtcactattggatgagttgggtccgcaggctccgagggaggcctggagtggggtggacccaaacagtaaaaggaagagtaggaagtgaagaagtctagtgtggactcgtgtgaaggggccgattcgatcatctccaganacaacgcgagaacctccctgtatctagacaaatcgaacagcctagagagtgagacaggctatgtattatgtgtagagtagaaagtaaaaggtcggggaaccaagggaaccctggtacaccggtctccgtacg

SEQ ID NO: 424101 - DNA, 531 bp, Homo sapiens
  misc_feature: GZ8MTXP02G8O83.9.64.F09.1.454.CMB.2.raw
  modified_base (294)..(294): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccncaggctccgagggaaggcctggagtgggtgcccaacagtaaaggaagatggaagtgagaagtcctatgtggactcgtgtgaagggccgattcatcatctccagagacaacgccgagaactccctgtatctagacaaatcgaacagacctagagagtacgaggacacggactagtgttattagttgtgtgagagaacgtaaaagtgggaacgaggaacccgtggacaccgtctcctcg

SEQ ID NO: 424102 - DNA, 513 bp, Homo sapiens
  misc_feature: GZ8MTXP02GXQK5.9.64.F09.1.454.CMB.2.raw
  modified_base (458)..(458): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagcactattggatgagttggtccgcaggctccaggggaggctggagtgggtgccaacataaaggagatggaagtgagagtctatgtggactctgtgaagggccgattcatcatctccagagacaacgccgagaactccctgtatctgacaaatgaacagcctgagagtcgaggacaggctatgtattatgtntgagagaagtaaaacggtgggacgaagggaaccctggtacaccgtctccgtcacg

SEQ ID NO: 424103 - DNA, 513 bp, Homo sapiens
  misc_feature: GZ8MTXP02FXA4G.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttggtccgccaggctccagggaaggcctggagtgggtggccaacataaaggaagatggaagtgagaagtcctatgtggactctgtgaagggccgattcatcatctccagagacaacgccgagaactccctgtatctgcaaatgaacagcctgagagtcgaggacacggctatgtattattgtgtgtagagataaaagtgggacaagggaacctggtcacgtcgcctcacg

SEQ ID NO: 424104 - DNA, 514 bp, Homo sapiens
  misc_feature: GZ8MTXP02F4B7F.9.64.F09.1.454.CMB.2.raw
  modified_base (302)..(302): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccngggaaggcctggagtgggtggccaacataaaggaagatggaagtgagaagtcctatgtggactctgtgaagggccgattcatcatctccagagacaacgccgagactccctgtatctgcaaatgaacagcctgagagtcgagacacggctatgtattatgtgtgagagataaaagtgggacgaagggaacctggtacacgtctccgtcaccg

SEQ ID NO: 424105 - DNA, 522 bp, Homo sapiens
  misc_feature: GZ8MTXP02F64UE.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgccaggctccaggggaagggcctggagtgggtggccaacataaaggaagatggaagtgagaagtcctatgtggactctgtgaagggccgattcatcatctccagagacaacgccgagaactccctgtatctgacaaatgaacagcctagagagtcgaggacacggctatgtattattgtgtgtagagagtaaaacgtgggacaagggaacctggtcaccgtctacctcacg

SEQ ID NO: 424106 - DNA, 542 bp, Homo sapiens
  misc_feature: GZ8MTXP02F6H02.9.64.F09.1.454.CMB.2.raw
  modified_base (405)..(405): a, c, t, g, unknown or other
  modified_base (537)..(537): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctgggggtccctgagactctcctgtgcagcctctggattcacctttagtcactattggatgagttgggtccgccaggctccgagggaagggcctggagtggggtggccaaacataaaggaagatggaagtgagaagtcctatgtggactcgtgtggaaaggggccgattcatccatctccaganacaacgaccgagaacctccctgtactctagacaaatgaacagacctgacgagtacggaggacacggactatagtattagttgtgtagagagaataaaaggtgggaacgacgggaaccctggtacaccggtcnccgtc

SEQ ID NO: 424107 - DNA, 551 bp, Homo sapiens
  misc_feature: GZ8MTXP02IW3US.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtcactcagagtatgagtacttggtggctggtatcagcagaaaccaggaaacgacccctaaactcctaatctatgatgcctctatttaggaaagtgggtacccatcgaagttcagccggcagtggatcgtgggacagtaattcactctcacatcagcagcctgcagcctgatgtatttcgactaaacttattactcgaccaacgtcctaaatacgttaggttacgtttccggaccgttagggaaccgtaaaaggtcggtaatacggtaacaaaacggtaacgtcggtacgggtctacggaccaacgtacttctcgttctttaccactttcccttccccg

SEQ ID NO: 424108 - DNA, 555 bp, Homo sapiens
  misc_feature: GZ8MTXP02JMQSZ.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtgggggtccctgagactctcctgtgcagcctctggattcacctttagtcactattggatgagttgggtccgccaggctccgaggggaagggcctgggagtggggtggaccaacataaaggagagtggaagtgagaagtcctatgtggactctgtgaagggccgatttcatcatctccagagacaacgccgagaacctccctagtactctgacaaatgaacacgacctagagaggtacgaggacgacggactatagtattattgtgttaggacgtaagaagtaaaaggtcggggacgaacggggaacccgtaggtccgaaccggtctacccg

SEQ ID NO: 424109 - DNA, 597 bp, Homo sapiens
  misc_feature: GZ8MTXP02I0BMS.9.64.F09.1.454.CMB.2.raw
  modified_base (287)..(287): a, c, t, g, unknown or other
  modified_base (321)..(321): a, c, t, g, unknown or other
  modified_base (326)..(326): a, c, t, g, unknown or other
  modified_base (344)..(344): a, c, t, g, unknown or other
  modified_base (358)..(358): a, c, t, g, unknown or other
  modified_base (361)..(361): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcgtggtttcgtgtaggctatttagaaggtgtcagtgtgaggtgcagctggtggagctgcgggaggcttggtccagcctggggggtccctgagactctcctgtgcagctctggatcaccttatcatatggatgagtggtcgcaggcnccaggaggctgagtggtggcgacataaagaaganagagngagaagtctatgtggatntgtagaggacgatnatnatctcagagacgaacgacgacgaactacctacgtatactacgaacgaaataacgaacgaacgacgtacgaagaacggtacggaacggaacggaacggtacgtaacgttaagttaagtttagtttaggttaggtaaggtaaaggtaaaggtaaaacggtaaaaagggtaaacggggtaaccgggaaaccggggtaaaccggtaaccggtaccgtaacccgttaccgtacccgtaccg

SEQ ID NO: 424110 - DNA, 543 bp, Homo sapiens
  misc_feature: GZ8MTXP02FS5BA.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccgcaggctccgagggaaggcctggagtggggtggcccaaacagtaaaaggaagataggaagtgagaagtctatgtggactcgtgtgaaagggccattcatcatctccagagacaacgccgagaactccctgtactctagacaaatagaaacagacctagaacgagtacgaggacacggactatgtattattgtgtagagagaagtaaaacggtgggaacgaagggaaccctgggaccaccgtctccgtacg

SEQ ID NO: 424111 - DNA, 534 bp, Homo sapiens
  misc_feature: GZ8MTXP02FJ3VL.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtcactcagagtatgagttacttggttggcctggtatcagcaagaaaccagggaaagccccctaaaactcctaatctatgatcgcctcctattttggaaaagtggggtcccatcaaggttcagccggacagtggatcgtagggacagaattcactctcacatcagcagcctgcagcctgattgtatttgactaaactttatactgaccaacgaccaattaaacttggttaactttccgggaccctaggggaaccaaaaggtggactagtaacaaaacgaactgtcgactgacaacctatctcgtcttacacttccttcccg

SEQ ID NO: 424112 - DNA, 567 bp, Homo sapiens
  misc_feature: GZ8MTXP02JZOQ0.9.64.F09.1.454.CMB.2.raw
  modified_base (432)..(432): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttgggtccagccgtggggggtccctgagactctcctgtgcagcctctggattcacctttagtcactatggatgagttggtccgcaggctccaggggaaggcctggagtgggtggccaacataaaggagatggaagtgagagtctatgtgactcgtgtgggaatccggattcatcatctccagagacaacgccgagaactccctgtactctgacaaagtgaacncgcgtagagacgacggacggacgacggtactagtagttaagttagttagtggtagaaggaacggaaagtaaaacgggtcggggaaccgaaccggggtaacccgtcggtacccgtacccgtcctacccgaccgacg

SEQ ID NO: 424113 - DNA, 537 bp, Homo sapiens
  misc_feature: GZ8MTXP02GOXL0.9.64.F09.1.454.CMB.2.raw
  modified_base (332)..(332): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagtcactatggatgagttgggtccgccaggctccgagggaaggcctggagtgggtggccaaanagtaaaggaagatggaagtgagaagtctatgtggactcgtgtgaagggccgattcatcatctcagagacaacgccgagaactccctagtatctagacaaaatgaaacacgacctagagagtcggaaggaacgacggctagtgtaattagttgtgtagagagaaagtaaaaggtgggaacgagggaacctggacaccgtctctccg

SEQ ID NO: 424114 - DNA, 521 bp, Homo sapiens
  misc_feature: GZ8MTXP02IQA8B.9.64.F09.1.454.CMB.2.raw
  modified_base (451)..(451): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttgcccggtcatcagagtatgagttacgttggtggcctggtatcagcaagaaaccgaggaaacgacccctaaactcctaatctatgatcgcctctagtttggaaagtcgggtccatcaggtcagcgcagtgatcgtaggacagatcactctacaccatcagcagcctgcagcctgatgtactttgacttaacttattacacgaccaacgctaatacgtgtacttccggaccgtaggaacctaagngtaacgtcgtaacaaaccgtataggtcgactgactaacgtacttcgtacgttctacgtacttcctacccg

SEQ ID NO: 424115 - DNA, 524 bp, Homo sapiens
  misc_feature: GZ8MTXP02FN3WU.9.64.F09.1.454.CMB.2.raw
  modified_base (376)..(376): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccctggggggtccctgagactctcctgtgcagcctctggattcacctttagtcactattggatgagttgggtccgccaggctccgagggaagggcctggagtgggtggcccaaacagtaaaggaagatgggaagtgagaagtcctatgtggactcngtgaagggccattcatcatctccagagacaacgccgagaactccctgtatctgacaaatgaacagcctagagagtcgaggacacggctatgtattatgtgtgagagaagtaaaaggtgggaacgaggaacctggtacacgtctcctcg

SEQ ID NO: 424116 - DNA, 526 bp, Homo sapiens
  misc_feature: GZ8MTXP02J2E6F.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttcctgttgctattttagaaggtgtccagtgtgaggtgcagctggtggagtctgcgggaggcttggtccagcctggggggtccctgagactctccctgtgcagcctctggattcacctttagtcactattggatgagttgggtccgccaggctccgaggggagggcctgggagtgggtggccaacataaaggagatggaagtgagagtcctatgtggactctgtgaaggggccgattcatcatctccagagacaacgccgagaacctcctgtatctgcaaatagacagcctgagagtcgaggacacgggctagtgtattattgttgtgagagaagtaaaaagtggggaccaagggaaccctggtcaccgtctcctcaccg

SEQ ID NO: 424117 - DNA, 555 bp, Homo sapiens
  misc_feature: GZ8MTXP02G0VYM.9.64.F09.1.454.CMB.2.raw
  modified_base (400)..(400): a, c, t, g, unknown or other
tcagtgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtccactcagagtatgagtacttggttggcctggtatcagcaagaaaccaggaaacgcccctaaactcctaatctatgatcgcctctatttggaaagtcggggtcccatcaaggtcagccggcagtgatcgtgggacagattcactctacacatcagcagctgcagcctgatgtatttgactaaacttnttactcgaccaacgcctaagtaaccttggttacgtttccggaccccgttaggggaaccctaaaaggtgtaactacggtaacgtaaaacgaacgttggtcggtacctggacctaacgtacttccgttcgttcctttactacgttccctttaccccg

SEQ ID NO: 424118 - DNA, 596 bp, Homo sapiens
  misc_feature: GZ8MTXP02H9ULB.9.64.F09.1.454.CMB.2.raw
  modified_base (359)..(359): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcgcccgtccatcagagtatgagttacgttggtggctggtatcagcaacgaaaccgaagggaaacacccctaaactcctaatctatgatcgccttctagttttaggaaaggtcggggtccatacgaaggttcaggccgagaggtgatcgnggacagtaacttcactctacacatcagcacgcctgaccagtccgtagtagttagttagttttagaccttaaactttatttaccacgtaccccaacgtacctaaagttaacggttacgggttactttcccgggacccggtacgggtaaccgtaaaggtcggtagtacggtaaacgaaacgtaacgtgtacggtctacgactaaccgtctcgttcttaccttcctacttacccctcccg

SEQ ID NO: 424119 - DNA, 532 bp, Homo sapiens
  misc_feature: GZ8MTXP02H816M.9.64.F09.1.454.CMB.2.raw
  modified_base (365)..(365): a, c, t, g, unknown or other
  modified_base (400)..(400): a, c, t, g, unknown or other
  modified_base (465)..(465): a, c, t, g, unknown or other
  modified_base (496)..(496): a, c, t, g, unknown or other
  modified_base (530)..(530): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctctggattctacctttagtcactattggatgagttgggtccgccaggctccgagggaaggcctggagtgggtgccaacataaaggaagatggaagtgagaagtctatgnggactctgtgaagggccgattcatcatctccaganacaacgaccgagaacctccctgtactctgacaaatgaaacagcctagagagcggaagacgacggntatgtattattgtgtgagagaagtaaaaggnggggaaccgacgggacctggacaccgtctacccncg

SEQ ID NO: 424120 - DNA, 531 bp, Homo sapiens
  misc_feature: GZ8MTXP02G1SEI.9.64.F09.1.454.CMB.2.raw
  modified_base (399)..(399): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtgggggtccctgagactctcctgtgcagcctctggattcacctttagtcactattggatgagttgggtccgccaggctccgaggggaaggcctggagtggggtggccaaacataaaggaagatggaagtgagaagtcctatgtgactcgtgtgaaggccgattcgatcatctccanagacaacgcgagactccctgtatctagctaaatcgaacacgccgtagagagtcgaggacacggctatgtattatgtgtagagagaaactaaaaggtgggaacgagggaaacccgtggacaccgtctcctacg

SEQ ID NO: 424121 - DNA, 523 bp, Homo sapiens
  misc_feature: GZ8MTXP02FXH3O.9.64.F09.1.454.CMB.2.raw
  modified_base (292)..(292): a, c, t, g, unknown or other
  modified_base (490)..(490): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttgggtccnccaggctccagggaaggcctggagtgggtggccaacataaaggagatggaagtgacgaagtccatgtggactctgtgaagggccgattcatcatctccagagacaacgccgagaacctccctagtatactgacaaatgaacagacctagagacgtcgaggacacggctagtgtattattgtgtgagtagaataaaagngggacgaaggaccctggcaccgtcaccgtcacg

SEQ ID NO: 424122 - DNA, 544 bp, Homo sapiens
  misc_feature: GZ8MTXP02I89UZ.9.64.F09.1.454.CMB.2.raw
  modified_base (367)..(367): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagttacgttggtggcctggtatcagcaagaaaccgagggaaacgacccctaaactcctaatctatgatcgcctctagtttaggaaagttcggggtccagtcaaggttcagccggcagtgatcgtggacagatcactcncacatcagcagcctgcagctgatcgtatttgactaaacttattactcgaccaacgcctaaattacgtaggttactttccggaccgtaggaaaccaaggtcggaactacgtaacgaaaacgtaacgtcggtcgacgtcgactaactacgttctacgttccttactacttccttccccg

SEQ ID NO: 424123 - DNA, 580 bp, Homo sapiens
  misc_feature: GZ8MTXP02HHJ1F.9.64.F09.1.454.CMB.2.raw
  modified_base (272)..(272): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagttacttggtggcctggtatcagcaagaaaccgaggaaacncccctaaactcctaatctatgatcgcctctagtttaggaaagtcgggtaccatacgaaggttcagccggacaggtggatcgtagggaacagtaacttcactctaccacatcagcacgcctgcagctagacttgtattttcgacttaaactttattaccacgtaccaacgtacctaaattaaccgttggttacgtttcccgggacccgttaggggaaacctaaaggtggtaactacggtaacaaaacggtacgttggtcggactcgacctaaccgtatccgttacgttccttactactttcccttcccg

SEQ ID NO: 424124 - DNA, 522 bp, Homo sapiens
  misc_feature: GZ8MTXP02JR70V.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagcactattggatgagttgggtccgccaggctccgaggggaagggcctggagtggggtggccaacagtaaaggagatggaagtgagagtctatgtggactctgtgaagggccgattcatcatctccagagacaacgccgagaactccctgtatctgacaaatgaacagcctggagagtcgaggacacggctatgtattagtgtgtgagagaataaaagtggggaccaagggacctcggtcaccgtctcctcaccg

SEQ ID NO: 424125 - DNA, 545 bp, Homo sapiens
  misc_feature: GZ8MTXP02HSQHY.9.64.F09.1.454.CMB.2.raw
  modified_base (478)..(478): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactatggatgagtggtccgcaggctcgagggaggcctggagtgggtgccaacagtaaaggagatggaagtgagaagtcatagtgtggactgtggtgaacgggccgaattcatcatctcagacgacacgccgagaacctccctagtactcgtagacaaatgaaacacgcctagagagtacggacggacgacggctagtgttattntgtgttagaagaagtaagtaaaaggtcggggacgacggggtacctaggtccgtaaccgttccgtacc

SEQ ID NO: 424126 - DNA, 638 bp, Homo sapiens
  misc_feature: GZ8MTXP02GWODZ.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctctggattcacctttagtcactattggatggagttgggtccgccaggctccgaggggaacggccgtgggagtggggtcggaccaaacaagtaaaaggaagagtggaaagtgaagaagtcctagtgtggacttcgtggtaggaaagggccgattcgatcatctcgagagacaacgccgagaacctccctagtactcgtacgaactaaagtagaaacgacgaccgtaggaacgacggtacggaacggaaccgacgggtacttagtagttaatttagttggttaggtaggtaaacggtaagtaaaaggttaaaaacggggtcggggaaccgtaacggggtaacccgttacggtacccgtacccggtcctacccgttacgaaccccgg

SEQ ID NO: 424127 - DNA, 631 bp, Homo sapiens
  misc_feature: GZ8MTXP02H9IQU.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctgggtggagtctggcggggaggcttgggtccagccgtggggggtccctgagactctcctgtgcagcctctggattcctacctttagtcactattggatgaggttgggtccgccgaggctccgaggggaacgggccgtggggaggtggggtacggacccaaaacgtaaagtaaaagggaagaagtggggaaagtgagtaaacgtcctaatggtggacttcgtggtagggaaaggggccgtattccatcatcctcagagaacaacgaccgacgaacctcctgtatctagacaaatgaaacagacctagagtacgacggaggacgacggactagtgtaatttattggttagtaggtaagaaagtaaacgtaaaaaggggtcggggaaccgtaaacggggtaaccccgtacggtacccgtacccggtaccttaccctacgacccgg

SEQ ID NO: 424128 - DNA, 529 bp, Homo sapiens
  misc_feature: GZ8MTXP02F8NJH.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactattggatgagttgggtccgccaggctccaggggaagggcctgggagtgggtggccaaacataaaggaagatggaagtgagaagtcctatgtggactctgtgaagggccgattcatcatctccagagacaacgccgagaactccctagtatctgacaaatgaacagcctagagagtcgaggacacggctatgtattattgtgtgagagaagtaaaagtgggacgaagggaccctaggtcaccgtctcctacaccg

SEQ ID NO: 424129 - DNA, 740 bp, Homo sapiens
  misc_feature: GZ8MTXP02GWU3Y.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttgggtccagccgtggggggtccctgagactctcctgtgcacgcctcgtggtattctacctttagtctacttagttggatggtaggttcgggtccccgccgaggcctaccggaaggggaacggggtccgtggggaggttggggtcggacccaaacgaagtaaaagggaagaagtagggaagtaggaagaagtcaatagtggtgggacttcgtaggtaggaaacgggtcccgtatttacactcatcctaccgaagaacgaacgaaccggaccgaaacgtaaccctccccgtagtacttaccgtacgtaactaaagtacgaaaccacggtacccgtaaggaacggtacggtacgggaaacgggaaccgtaacggggtacttaaagttacggtttaagttttagttacggtttaggtaaggtaaaggtaaaggtaaaacggtttaaaaagggggtccgggggaacccggtaaaacgggggtaaacccccgttcggggttaccccgtaaccccgggtttctttaacccccgg

SEQ ID NO: 424130 - DNA, 598 bp, Homo sapiens
  misc_feature: GZ8MTXP02G1XHS.9.64.F09.1.454.CMB.2.raw
  modified_base (272)..(272): a, c, t, g, unknown or other
  modified_base (404)..(404): a, c, t, g, unknown or other
  modified_base (441)..(441): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtcctccttccacctgtctgcatctgtaggagacagagtcacatcacttgccgtcactcagagtatgtagtacgttggtcggcctggtatcagcaaggaaaccagggaaacncccctaaactcctaatctatgatcgcctactagttttaggaaagttcggggtacccagtacgaaaggttcaggcccggacaggtggactcgtagggactagaacttcactcctacacctatcagcacgtccngcacgtcctgtatgtatttcgacttaaattacttacncgtaccaacgtactaacgttaacgttggttaccttccgggaccgtacggggaacctaaagggtcgtaacgtacggtaactaaaacggacgttggacgtccgtacgaccgaaccttagtccgtttacgtacctttacctaccgttcccgtttaccccg

SEQ ID NO: 424131 - DNA, 529 bp, Homo sapiens
  misc_feature: GZ8MTXP02GVHDA.9.64.F09.1.454.CMB.2.raw
  modified_base (359)..(359): a, c, t, g, unknown or other
  modified_base (414)..(414): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtcactcagagtatgagtcttggtggctggtatcagcaagaaaccgaggaaacacccctaaactcctaatctatgatcgcccttacgtagtttaggaaaggttcgggtacccagtacgaaggttcaggccggcagtgatcgtgganagtactcactctcacatcagcagcctgcagcctgtatgtatttcgactaaacttntactcgaccaacgtctaatacgtgttacttcggaccgtaggaacctaaagtgaactacgaacaacgtagtggtcgactcgacctaactacgtctcgtctctacttccgtaccccg

SEQ ID NO: 424132 - DNA, 559 bp, Homo sapiens
  misc_feature: GZ8MTXP02GBLHU.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagcactattggatgagttgggtccgccaggctccgaggggaagggcctggagtgggtggccaacagtaaaggagagtggaagtgagaagtcctatgtggactcgtgtggaagggccgattcatcatctcagagacaacgccgacgaaccccctgtactctagacaaatacgaacacgaccgtagagacgtcgaggaacgacggactatagttattattggtgtaggagaagtaaacgtaaaaggtcggggaaccgaacgggaacccgtcggtaccaccgtcgtcctaccg

SEQ ID NO: 424133 - DNA, 516 bp, Homo sapiens
  misc_feature: GZ8MTXP02J195V.9.64.F09.1.454.CMB.2.raw
  modified_base (291)..(291): a, c, t, g, unknown or other
  modified_base (317)..(317): a, c, t, g, unknown or other
  modified_base (322)..(322): a, c, t, g, unknown or other
  modified_base (351)..(351): a, c, t, g, unknown or other
  modified_base (376)..(376): a, c, t, g, unknown or other
  modified_base (381)..(381): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagcactatgatgagttggtccncaggctccgagggaggctggagtggngcaanataaaggagatggaagtgagagtctatgngactgtgtgaaggcattcatcatcncaganacaacgcgagaacctcctgtatctgacaaatgaacagcctagagagtacgacggacacggctatgttacttatgtgtcgaagagaaagtaaaacggtggggaacgacgggaacctcggtaccaccgtctctaccg

SEQ ID NO: 424134 - DNA, 743 bp, Homo sapiens
  misc_feature: GZ8MTXP02GCND6.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctcgtggtacttctacctttagctactattggatggtaggttcgggtccgccgaggctccgaggggaacggccgtggaggtggggtcggaccaaagaagtaaaagggaagagtaggaaagtggaagtaacgttcctagtggtggacttcgtgggtaggaaacggggtccgtattcgaatcacttccgtaccaagaacgaaccaaccggcccgaaacgacccttcccgtagtactcgtacgaactaaagtacgaaaccgtagacccgtagggaacgtacgggtacggaacgggaaccgtaccgggtacttaagtttacgtttaaagttttacggtttagggttagggttaagggtaaacggtaaaagggtaaaaagggttaaaaaacgggggtccgggggtaaaaccccggtaaacgggggttaaacccccggttacggggtaacccccgttaaccccggttacccttaccccgttaccggtaaacccccgg

SEQ ID NO: 424135 - DNA, 526 bp, Homo sapiens
  misc_feature: GZ8MTXP02I4NXX.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcaccttagtcactattggatgagttgggtccgccaggctccgagggaggcctggagtggggtggcccaacataaaggaagatggaagtgagaagtctatgtggactcgtgtgaagggccgattcatcatctccagagacaacgcgagaactccctgtactctgacaaatgaacacgcctgagagtcgagggacacggctatgtattattgtgtgagacgaagtaaaaggtggggaacgagggaacctcggcgaccgtctcctacg

SEQ ID NO: 424136 - DNA, 511 bp, Homo sapiens
  misc_feature: GZ8MTXP02JTKLS.9.64.F09.1.454.CMB.2.raw
  modified_base (353)..(353): a, c, t, g, unknown or other
  modified_base (402)..(402): a, c, t, g, unknown or other
  modified_base (492)..(492): a, c, t, g, unknown or other
tcagtgatacgtctcacgaccggtgctcgatttagcgcgtatacaagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcaagaaaccgaggaaacgcccctaaactcctaatctatgatgcctccagttttggaaagtggggtaccatcaagttcagccggcagtggatcgtagggacngtaatcactctcaccatcagcagcctgcagctgatgatttgactaattnttactcgaccaacgtcctaattaactggttactttccgggacctggggaaccaaaggtggactgtacaaacgtactgtacgctagcaacnttctctctctactctcccg

SEQ ID NO: 424137 - DNA, 548 bp, Homo sapiens
  misc_feature: GZ8MTXP02GE6QE.9.64.F09.1.454.CMB.2.raw
  modified_base (382)..(382): a, c, t, g, unknown or other
  modified_base (446)..(446): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggcttggtccaggccgtggggggtccctgagactctcctgtgcagcctcgtggattcaccctttagcactattggatgagttgggtccgccaggctccaggggaagggcctgggagtggggtggccaaacataaaaggagagtaggaagtgagaagtcctatgtggactctggngaaggggccagttcatcatctcagagacaacgccgaagacctcctgtatctgacaaatagaacngacctagagacgtcgaggacacggctatagtattagttgtgttagacgaagtaagtaaaacggtgggaccgaaggaacccgtggaccaccgtctcctcaccg

SEQ ID NO: 424138 - DNA, 534 bp, Homo sapiens
  misc_feature: GZ8MTXP02J07PX.9.64.F09.1.454.CMB.2.raw
  modified_base (292)..(292): a, c, t, g, unknown or other
  modified_base (309)..(309): a, c, t, g, unknown or other
  modified_base (323)..(323): a, c, t, g, unknown or other
  modified_base (401)..(401): a, c, t, g, unknown or other
  modified_base (408)..(408): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctggtgcagcctctggattcacctttagcactatgatgagttggtccncaggctcgagggaggcnggagtgggtgcaanagtaaaggagatggaagtgagagtctatgtggactcgtggtgaacgggccattcatcatctcagagacgaacgccganacctccngtactctgacaaatagacacgcctagacgaggtacgaggacgacggtactagtgtattagttgtgtagagagaacgtaaaaggtggggaaccgaggggaaccctcggtaccaccgtcctccgtacc

SEQ ID NO: 424139 - DNA, 595 bp, Homo sapiens
  misc_feature: GZ8MTXP02IE5QV.9.64.F09.1.454.CMB.2.raw
  modified_base (189)..(189): a, c, t, g, unknown or other
  modified_base (520)..(520): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctccaggtgccaaatgtgacatccagatgaccagtctccttccacctgtctgcatctgtagganacagagtcaccatcacttgccggtccactcagagtatgtagttacgttggtggcctggtatcgagacaagaaaccgaggggaaacacccctaaaactcctaatctatgatcgacccttacttaaggtttaggaaaaggttcggggtaccctaagtacgtaaggtcaggcccggactaggtggactcggtaggggaacagtaacttcactctacacatcagcacgctgcacgtctagattggtaatttcgacttaaatttacttactcgaaccaacgtactaaattaacgttcggttactttcccgggaccgtaacgggtaaacctaaaggngtaacttacgaaccaaaacgtcgtgtacggccttacgacctaactacgtcttctccttacgtactttccctcccg

SEQ ID NO: 424140 - DNA, 596 bp, Homo sapiens
  misc_feature: GZ8MTXP02HV7FY.9.64.F09.1.454.CMB.2.raw
  modified_base (298)..(298): a, c, t, g, unknown or other
  modified_base (593)..(593): a, c, t, g, unknown or other
tcagtgatacgtctcacgaccggtgctcgatttagcgcgtatacaaggggtcagagaggagccttagccctggactcaaaggccttttccacttggtgatcagcactgagaacagaggactcaccatggaattgggctgagcttgggttttccttgttgcttattttagaaggtgtccagtgtgaggtgcagctggtggagtctggcgggaggcttggtccaggccgtggggggtccctggagactctcctgtgcagcctctggattcacctttagcactattggatgagttggtccnccgaggctccgagggaacggccgtggagtgggtgaccaaacgaagtaaaaggaagagtagggaagtgaagaagttcctatggtaggacttcgtggtagaagggccgtaattcgaatcatctaccagaacgacaacgtaccgaagtaacctcccgtagtactacgtagacaaatacgaacacgaccgtagaagagacggaaggacgacggtactagtgttaattagttgacgttagagtaacgaaagttaaaaggcggggaaccgacgggaaccgtacgaccgtaccgtcttaccnccg

SEQ ID NO: 424141 - DNA, 564 bp, Homo sapiens
  misc_feature: GZ8MTXP02GNWAW.9.64.F09.1.454.CMB.2.raw
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagttacttggttggctggtatcagcaagaaaccagggaaacgcccctaaactcctaatctatgatcgcctacctagttttaggaaaggttcggggtacccagtacgaaggttcaggccggacaggtggatcgtagggactagaacttcactctccacatcagcagcctgcagcctgatgtatttgactaatttatactcgaccaacgcctaataaccgttggttacgtttccggaccgttagggaacctaaaggtcgtattacggaacaaaacggtaactggtacggctcggtaccaaccgtatcttcgtcctttacacctttccgttaccccg

SEQ ID NO: 424142 - DNA, 597 bp, Homo sapiens
  misc_feature: GZ8MTXP02I8WUT.9.64.F09.1.454.CMB.2.raw
  modified_base (356)..(356): a, c, t, g, unknown or other
  modified_base (407)..(407): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaacgcccctaaactcctaatctatgatgcctcctattttaggaaagtcggggtcccatacaaggttcagccggcagtggatcgtgggacngaattcactctcacatcagcagcctgcagctgatgtatttgactaaacttnttaactcgacccaacgcctaagttaaccgttggttaacttttcccggggccccgttagggggaaaccctaaaagggtcgggtaaattacggtaaccgtaaaaccggtaaaccgtcgggttcgggaccttacgggacccaacccgtaattccgttcggttcctttaccgtaactttcccctttaccccccg

SEQ ID NO: 424143 - DNA, 526 bp, Homo sapiens
  misc_feature: GZ8MTXP02H6HJO.9.64.F09.1.454.CMB.2.raw
  modified_base (345)..(345): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtgggggtccctgagactctcctgtgcagcctctggattcacctttagtcactattgatgagttggtccgcaggctccgaggaggcctggagtgggtgacaacgataaaggaagatggaagngaagagtctagtgtggctcgtgtgaagggccgattcatcatctccagacgacaacgccgaagaacctccctgtactctgacaaagtgaacagcctagagagtacgaggacgacggctagtagtatttatgtgtgagagtaagtaaaaggtgggacgacggacctacggtcaccgtactccg

SEQ ID NO: 424144 - DNA, 565 bp, Homo sapiens
  misc_feature: GZ8MTXP02JZA20.9.64.F09.1.454.CMB.2.raw
  modified_base (511)..(511): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagtcactattggatgagttggtccgcaggctccgaggggaaggcctgggagtggggtggaccaacaagtaaaggaagatggaagtgaagagtctatgtgactcgtgtgaaaggccgattcatcatctcagagacaacgccgagaacctccctagtactctagacaaatagaacagcctagagagtacggaggacgacggctagtagtattagttgtggtaggaagaggaaaagttaaaaacggnggggaccgaacggggtaacccgtacgggtaccaccggtcctaccgtacgacccg

SEQ ID NO: 424145 - DNA, 610 bp, Homo sapiens
  misc_feature: GZ8MTXP02GNM8U.9.64.F09.1.454.CMB.2.raw
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagttacttggttggcctggtatcagcaagaaaccaggaaacgcccctaaactacctaatctatgatcgcctctagttttaggaaaggtcggggtacccagtacgtaaggttcaggccggcaggtggagtcgtagggacagtaattcactctacacatcagcacgcctgacagcctgattgtatttcgacttaaactttacttactacgtaccaaaccggtcctaagttaaccgttaggttacgtttccggggaccccgttaacggggtaaccctaaaagggttcggtaactacgggttaaccaaaacggtaaacgttggtacggtccgtacgacctaacctacgttccgttacgttcctttactactttccctttcccccg

SEQ ID NO: 424146 - DNA, 513 bp, Homo sapiens
  misc_feature: GZ8MTXP02IXGYE.9.64.F09.1.454.CMB.2.raw
  modified_base (415)..(415): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagcctggggggtccctgagactctcctgtgcagcctctggattcacctttagtcactattggatgagttggtccgcaggctccagggaggcctggagtgggtggccaacataaaggagatggaagtgagagtctatgtggctctgtgaagggccgattcatcatctcagagacaacgccgagaactccctgtatcngacaaatgaacagcctagagagtcgaggacacggctatgtattattgtgtgagagaagtaaaaggtgggacgacgggaacctggtacaccgtctcccg

SEQ ID NO: 424147 - DNA, 561 bp, Homo sapiens
  misc_feature: GZ8MTXP02GO7SC.9.64.F09.1.454.CMB.2.raw
  modified_base (426)..(426): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctgggtggagtctggcgggaggcttggtccagccgtggggggtccctgagactctcctgtgcagcctctggattcacctttagcactattggatgagttgggtccgccaggctccgaggggaagggcctgggaggtggggtggaccaaacgagtaaaagggaagagtaggaagtgacgaagtcctatggtggactgtggtgaacggggccgattcatcatctcagagacaacgccganaacctccctgtactctgacaaatacgaacagacctagacgagtcgaggacgacggctagtgtattagttgtgtgagaagaagtaaaaggtggggaccgaagggtaacccgtggtaccaccgtctccctacgaccg

SEQ ID NO: 424148 - DNA, 747 bp, Homo sapiens
  misc_feature: GZ8MTXP02J0D1O.9.64.F09.1.454.CMB.2.raw
  modified_base (137)..(137): a, c, t, g, unknown or other
  modified_base (377)..(377): a, c, t, g, unknown or other
tcagtgatacgtctcacgaccggtgctcgatttagcgcgtatacaaggggagagaggagccttagccctggactcaaaggcctttccacttggtgatcagcactgagaacagagactcaccatggaattggggctgngtcttgggttttccttgttgcttattttagaaggtgtccagtgtgaggtgcagtcgtgggtggagtcgtggcgggaggtccttgggtcccgagggtcccggtgggggggttcccctggacgtaccttccttccgtggtcgcacgtccttcgtaggtacttcctacctttagtcactagttggatcggagttcgggtccgcgaggcgtacggaggggacggcgtggagtgggtcgaccaanagtaaaggagtagtaggagtagacgtactcgaagttggagcgttcgtgggtagggaacctttccggattaccgactccatacccgtaacccgaaaggaaacccgaaccgaaacccggacccgtaaacgtaaccccgtccccggtaattaccgttaccgtaacgaacctaaagtaccggaaagcccgtaccggtagggaacggtcgacgggaaacggtaccggtaccgacgtttagtttaggttagtttaaggttggttaggaacggtaaaggtaaacggaaacggttaaaaccggggtccggggtaaacccggtaaccgggtaccccgtcgggttacccctaccggtccccgtacccgtaccgacccccg

SEQ ID NO: 424149 - DNA, 573 bp, Homo sapiens
  misc_feature: GZ8MTXP02IQE4T.9.64.F09.1.454.CMB.2.raw
  modified_base (323)..(323): a, c, t, g, unknown or other
  modified_base (328)..(328): a, c, t, g, unknown or other
  modified_base (337)..(337): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgcttattttagaaggtgtccagtgtgaggtgcagctggtggagtctggcgggaggcgttggtccaggccgtggggggtccctggagactctcctgtgcagcctctggacttcacctttagctactattggatgagtggtccgcaggctcgaggaggctggagtggngcaanataaagganagtggaagtgagaagtcatagtgtgctctggtgaagggccgtattcatcatctcagagacacgccgagaacgtcctagtatctagacaaatacgaactagacctagaacgagtacggacggacacggactaagttacgtatttagttggttagtaggaagtaaacgtaaagtaaaaaggggtaacggggaccgaaacgggggtaccccgtagggtaccctaaccggtaccttcccg

SEQ ID NO: 424150 - DNA, 615 bp, Homo sapiens
  misc_feature: GZ8MTXP02IRGL0.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagcttgggttttccttgttgctattttagaaggtgtccagtgtgaggtgcagctgggtggagtcgtggcgggaggtcttggtccaggccggtgggggtccctgagactctcctgtgcagcctctggattcacctttagtctactattggatgagttcggtccgcgaggctccgaggggaacggccgtggaggtggggtcggccaaacgaagtaaaaggaagaagtaggaagtagaagaagtcctaagtgtagactcgtgtaggaagggccgtattcatcatctccaagacgaacgaacgccgaagaacctaccctagtactcctagacaaatgaaacagacctagagagtacgaggacaacggctaagttagttaatttagttaggtagttagagtaaagtaaaacgtaaaaaggggtaacggggaaccgaacggggtaaacccgtacggtaccgtaacccggttccttaccccg

SEQ ID NO: 424151 - DNA, 631 bp, Homo sapiens
  misc_feature: GZ8MTXP02GPHXF.9.64.F09.1.454.CMB.2.raw
tcagtgatacgtctcacgaccggtgctcgatttagcgcgtatacaaggggctcagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtctggcgggaggcttggtccaggccgtgggggtccctgagactctcctgtgcagcctctggacttcacctttagtctacttagttggattggtaggtttcggggtccccgccgaacgggtcctaccggaagggggaacggggtcccgtggggaggtggggtcggaccaaacgaagtaaaaggaagagtaggaagtgaagtaagtctagtgtgctcgtgtaggaacgggccgtattcatctatcctccagacgaacgaacgccgaacgacctccctagtactctagaccaaagtgaaactaggacctaggacgacgtacggacgacacggtactagtagttatttagtggtagtagaacggaaagtaaaaggttaaaacggcgggggaaccgaacggggtaacccgtggtacccgtaccgtacttccccg

SEQ ID NO: 424152 - DNA, 535 bp, Homo sapiens
  misc_feature: GZ8MTXP02GG8UA.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggcttggtccagccgtggggggtccctgagactctcctgtgcagcctctggattcacctttagcactattggatgagttgggccgccaggctccgaggggagggcctggagtgggtggccaacgagtaaaggagagtggaaagtgagagtcctatgtggactgtgtgaagggccgattccatcatctcagagacacgaccgacgaacctcctgtatctagacaaatgaacagcctagagagtcgaggacacggctagtgtattagtgtgtagtagagaagtaaaaggtgggaccgaagggaccgtggtaccaccgtctccactaccg

SEQ ID NO: 424153 - DNA, 622 bp, Homo sapiens
  misc_feature: GZ8MTXP02JKN3K.9.64.F09.1.454.CMB.2.raw
  modified_base (566)..(566): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagccctgtgattctacctttagcacttattgggatggtagttgggtcccgacaggccgtaccggaggggaacgggcctagggacggtggggtcggaccaaaacgaagtaaaaggaagagtaggaacgtgagtaacgtcctagtggtaggtacctgtggtacggaaggggtcccgtattcgatcattccacagacgacaccgcgtaacgacctcccgtagtactctagaacaatacgaaacgcgaccgtagagacggtacggaaggacgcggtatagtgtaatttagtgtagtagaagtaacgaaagttaaaacgggngggtaaccgaacgggtaacccgttcggtaccgtaccggtcttacccgcgtaacccg

SEQ ID NO: 424154 - DNA, 528 bp, Homo sapiens
  misc_feature: GZ8MTXP02F6ULY.9.64.F09.1.454.CMB.2.raw
  modified_base (296)..(296): a, c, t, g, unknown or other
  modified_base (374)..(374): a, c, t, g, unknown or other
  modified_base (443)..(443): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtggggggtccctgagactctcctgtgcagcctctggattcacctttagtcactattggatgagttgggtccnccaggctccgagggaggcctggagtgggtggccaaacagtaaaaggaagatggaagtgagaagtctatgtggactcgngtgaaggggccgattcatcatctccagagacaacgaccgagaactccctgtatctgacaaatagaacanccgtagagagtcgaggacacggactatgtattagtgtgtagagagaagtaaaagtgggaacgaggacctcgcgacgtcgtctacg

SEQ ID NO: 424155 - DNA, 527 bp, Homo sapiens
  misc_feature: GZ8MTXP02FKF08.9.64.F09.1.454.CMB.2.raw
  modified_base (295)..(295): a, c, t, g, unknown or other
  modified_base (331)..(331): a, c, t, g, unknown or other
  modified_base (361)..(361): a, c, t, g, unknown or other
  modified_base (367)..(367): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagtcactattggatgagttgggtccncaggctccgagggaaggcctggagtgggtgccaaanataaaggagatggaagtgagaagtctatgngactcngtgaagggccattcatcatctccagagacaacgccgagaactcccgtgtactctagacaaaatcgaaacagacctgaagagtacgaggacacggctatgtattatgtgtgagagaaagtaaaaggtcggggaacagggaccctggaccaccgtctctacg

SEQ ID NO: 424156 - DNA, 704 bp, Homo sapiens
  misc_feature: GZ8MTXP02JOHZ3.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagccgtgggggtccctgagactctcctgtgcagtcctctggattcctacctttagtcacttattgggattggaggttcgggtaccccgcgaacggcctacccggaggggaacgggtccgtaggggaggtggggtcggacccaaacgaaaggtaaaagggagaagtagggaaagtgaacgtaagtcctaagtggtggaacttcgtggtagggaaacggggtcctaagttcgaatacctagtccctaccgaagaacgaaccgaacggcccgaaacgtaccctacccgttaggtaactcgtacgtaacaaagtagaaaccagcctagggaagtacggacgaacggacgacgggtactagttagtaagtttaagttggttcggtaaggtaagtaaagggtaaaaccgttaaaaagggtccgggggtaaaccgaacgggggtaaaaccccgttcgggtaccctaccggtacccttacccggactaaccccgg

SEQ ID NO: 424157 - DNA, 565 bp, Homo sapiens
  misc_feature: GZ8MTXP02JNNHU.9.64.F09.1.454.CMB.2.raw
  modified_base (289)..(289): a, c, t, g, unknown or other
  modified_base (321)..(321): a, c, t, g, unknown or other
  modified_base (391)..(391): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctctgtgcagcctctggattcacttagcactatggatgagttggcncagctcgagggacggctggagtgggtgccaanagtaaaggagataggaatgagaagtcatagtgtaggctcgtgtagggaacggggtccgtattcatcatcncagagaaccgaacgaccgaacgaacctccctagtactctgacaatacgaacacgacctaggaggagtacggacggacgacgggtctaagttagttattagttaggtggtagaaggaagtaagtaaaaagggcggggaaccggaacggtacccgtggtaccgtaccgtctacccg

SEQ ID NO: 424158 - DNA, 603 bp, Homo sapiens
  misc_feature: GZ8MTXP02IOBM3.9.64.F09.1.454.CMB.2.raw
  modified_base (429)..(429): a, c, t, g, unknown or other
  modified_base (431)..(431): a, c, t, g, unknown or other
  modified_base (433)..(433): a, c, t, g, unknown or other
tcagtgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgtccactcagagtatgagttacttggttggcctggtatcagacaagaaaccgaagggaaacgcccctaaactcctaaatctatgatcgcccttaccgtaagtttttagggaaaacggttcggggtacccctagttacgtaaagggttcaggcccggacgagtggaatcgtaggggacaggtaatttaccacttcctaccacaatcaaagcacgtccncncncgctagtatagttattatacttaacttacttactactaccaacgtacctaacgtaacgttacgttacgttaccggtaccgtacggtaacgtaagtagtacgtacgtaacgtaaacgtaacgtacgtacgtacgacgactaactactcttcttactactaccttcctaccg

SEQ ID NO: 424159 - DNA, 567 bp, Homo sapiens
  misc_feature: GZ8MTXP02JCLI3.9.64.F09.1.454.CMB.2.raw
  modified_base (297)..(297): a, c, t, g, unknown or other
  modified_base (332)..(332): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttgggtccaggccgtggggggtccctggagactctcctgtgcagcctctggattcacctttagcactattggatggagttgggccnccaggctccgagggaggctggagtgggtgaccaanagtaaaggagagtagggagtgagaatctagtggtggactcgtgtaggaacgggccgaattcatcaatctaccagagacaacgaccgagaacctccctgtatctagacaaatgaacagaccgtagagagtcggaaggacgacggtatagttaggttattagttagtgtagaagtagaaagtaaaacgggtggggaaccgacggggaaccgtcggtaccgacccggtctccctaccg

SEQ ID NO: 424160 - DNA, 668 bp, Homo sapiens
  misc_feature: GZ8MTXP02GFKG1.9.64.F09.1.454.CMB.2.raw
  modified_base (562)..(562): a, c, t, g, unknown or other
  modified_base (628)..(628): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtcgtggcgggaggcttgggtccgaggccggttcggggggtccctggacgactctcctgtgcagcctcgtggattcacctttagctacttagttggatggaggttcggggtcccgccgagggtcctaccggaagggggaacggggcccgttaggggaggttcgggggtcggaccctaaaacgaaggttaaaaaggggaagagtagggaaaggttaggaaggtaacgttcctaagttggtacggacttcggtggtacggaaacgggggtcctaagttcagtctaacttccgtacccgaaggaacgaaccgaaacccggaccggaacgtaacccttcccgtagtactcgtagactaaagtcgaacncgacctagagacgtacgaggaacacggactagtgttattagtgtagtagagaagtaaagtaaaggngggaacgaacgggaccgtggtacctaccggtctacctacg

SEQ ID NO: 424161 - DNA, 731 bp, Homo sapiens
  misc_feature: GZ8MTXP02JYVWL.9.64.F09.1.454.CMB.2.raw
tcagtgatacgtctcacgaccggtgctcgatttagcgcgtatacaaggggagagaggagccttagcccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcactttagtcactattggatgagttggccgcgaggctccgaggggaacgggcctagggaggtggggtcggaccaaacgaagtaaaaggaagaagtaggaaagtggaacgtaacgtcctagtggtaggaccttcgtggtaggaaacggggtcccgtagtttccaatcctataccctaccgaaaggaacgaaccaaaccggacccgtaaagaaccccttacccgtagtaaacttcctacggaaactaaaacgttacggaaaaccgtacgacccgttagggaacgtacgggttaccggaagggtaacccgaccggggttactaagtttagttaattttaacggttaggttagttaggaaacgtaaaggtaaaaacgttaaaaaaggggtccgggggtaaacccgtaaacgggggtaaacccccgtttacggggacccgttaaccccggttccttaccccgttacgaaccccgg

SEQ ID NO: 424162 - DNA, 660 bp, Homo sapiens
  misc_feature: GZ8MTXP02IIDCN.9.64.F09.1.454.CMB.2.raw
  modified_base (284)..(284): a, c, t, g, unknown or other
  modified_base (301)..(301): a, c, t, g, unknown or other
  modified_base (322)..(322): a, c, t, g, unknown or other
  modified_base (328)..(328): a, c, t, g, unknown or other
  modified_base (335)..(335): a, c, t, g, unknown or other
  modified_base (369)..(369): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgcttattttagaaggtgtccagtgtgaggtgcagctggtggagtctggcggggaggtcttggtccaggccgtggggggtccctgagtactctcctgtgcagcctctggattcctacctttagcactnttggatgagtcggtccncaggctcgagggaggcctggngtgggngaccaanagtaaaggagagtaggaagtgaagagacatatgngctgtgtgagggccgtattcatcatcctacgagagaaccaacgccgaagaccctacccgtagtactacgttacgaactaaaagttacggaaactacggtacccgttaaggaagggaacggttacgggaaacggggaaccgaaccggggtacttaagtttaggtttaagttttaagtttggttaaggtacggtaaggtaaaaggtaaaaggttaaaaaacggggttcgggggaaaacccgtacgggggaaacccccgttgggtacccgttaacccgttccgtttacccccgg

SEQ ID NO: 424163 - DNA, 569 bp, Homo sapiens
  misc_feature: GZ8MTXP02HGZU3.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagcttgggttttccttgttgctattttagaaggtgtccagtgtgaggtgcagctgggtggagtctggcggggaggcttgggtccaggccgtggggggtccctggacgactctcctgtgcagcctctggattcacctttagcactattggatgagttggtccgcaggctccgaggggaacggccgtggaggtgggtggccaaacgataaaaggagagtaggaagtgagagtcctatgtgactctggtgaagggccgtattcatcatctaccagacgacaacgccgagacctccctgtactctagacaaatgaactagacctagaagagtacggacgacgacggctagtagtattagtgtgtagaagagtaaagtaaaacggtggggaccgaacgggtaaccctacggtaccaaccgtcctaccgtacgacccg

SEQ ID NO: 424164 - DNA, 682 bp, Homo sapiens
  misc_feature: GZ8MTXP02G0W6K.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctgggtggagtcgtggcggggaggtcttgggtccaggccggtcggggggtccctggagactctcctgtgcacgcctcgtggacttcctacctttagctacttattggatggtaggttcgggtccgccgaggcctaccggaaggggacggccgtagggaggtggggtcggacccaaagaagtaaaagggaagagtagggaagtgaagtaacgtcctaagtggtacggacttcgtggtaggaacgggtcctattcatcatcctaccagacgaccgaacgaccgaacaacctcccgtagtactacgtagacctaaaagtcgaaacacgtaccgtaggaacgtacggtacggaacggtaacgacggtactaagttagtttaatttagttaggtaggtaaggaaagtaaacgtaaaaggttaaaacggggtcgggggaacccgtaaacggggtaaccccgttacgggtacccgtaaccggttcctacccgtaacccg

SEQ ID NO: 424165 - DNA, 564 bp, Homo sapiens
  misc_feature: GZ8MTXP02FRFTY.9.64.F09.1.454.CMB.2.raw
  modified_base (292)..(292): a, c, t, g, unknown or other
  modified_base (323)..(323): a, c, t, g, unknown or other
  modified_base (353)..(353): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcacctttagtcactatggatgagttggtcncagctccgaggaggctggagtggtgaccaanagtaaaggagatggagtgagagtcctatgnggactgtgtgaagggcctattcatcatctaccagagacaaccgaccgagaacctccctgtactcgtgacaaatcgaacacgaccgtagaacgtagtaccggaaggacctaggactagtggttaattagttggtgtagaaggtagtaaaacgtaaaagggtcggggaaccgacggggaaaccccgttagggtaccaaccggtcctcctaccg

SEQ ID NO: 424166 - DNA, 613 bp, Homo sapiens
  misc_feature: GZ8MTXP02GU1TG.9.64.F09.1.454.CMB.2.raw
  modified_base (326)..(326): a, c, t, g, unknown or other
  modified_base (335)..(335): a, c, t, g, unknown or other
  modified_base (402)..(402): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctctggattcactttagtcactattggatgagttgggccgccaggcctccgagggacggcctggagtgggngacccaaanagtaaaggagagtaggaagtgagaagtctagtgtgactgtgtagaggccgattcatcatctacaganacaaccgcgacgaactcccgtagtactctagactaaatgaacagccgtagaagagtaccggaggaccgacgggacttagttgttaattagtttggttagttaggagaaaaggtaaaacggtttaaaaaacgggtcgggggaacccgtaaaccgggggtaaaaccccgttcggggttaacccgtaacccggttcccgtttaccctaaccccg

SEQ ID NO: 424167 - DNA, 539 bp, Homo sapiens
  misc_feature: GZ8MTXP02IXC2Y.9.64.F09.1.454.CMB.2.raw
  modified_base (467)..(467): a, c, t, g, unknown or other
  modified_base (516)..(516): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtgggggtccctgagactctcctgtgcagcctctggattcacctttagcactattggatgagttggtccgccaggctccgaggggaaggcctggagtggggtggacccaaacgataaagggaagataggaagtgacgaagtcctatgtggactctgtgaagggccgattcgatcatctccagagacaacgccgagacctccctgtactctgacaaatgaacagccgtagagagtcggaggacacggntatgtattagtgtgtgagagaagtaaaacgtcgggacgaacgggtaccncggtacgaccgtctcctacaccg

SEQ ID NO: 424168 - DNA, 758 bp, Homo sapiens
  misc_feature: GZ8MTXP02GM986.9.64.F09.1.454.CMB.2.raw
  modified_base (555)..(555): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagcgtggtggagtcgtggcggggaggtcgttggtcccgaggtcccggttcgggggggtcccctggacgtaccttccgttccgtggtcgccacgtcccttcgtggtactttcctacctttagtctacttagttggtatggtaggttcgggtcccgccgaggtcctaccgggaggggacggtccgtagggtagggtggggtacggacccgaaacgtaaggtaaaagggaaaggtagtagggaagtagaaggtaacgttactagtggtacggtactcgtggtagggaacgggtccgtatcgatctactctaccgagacgaccaacgccgaacgtacctccgtagtactctaagactaaagtcgaaacncggtacgtaggaacgtacggtacggaacggaaccgtacgggttacttagttagtttaatttaggtttgggtaaggttaaggaaagggtaaaaccgtaaaaaggggtttaaaacgggggccgggggtaaacccgtaaaacccgggggttaaccccgtttaccggggtaccccctaaccgggtttccctacccgtttaaccccgg

SEQ ID NO: 424169 - DNA, 614 bp, Homo sapiens
  misc_feature: GZ8MTXP02GCHT6.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttcctgttgctattttagaaggtgtccagtgtgaggtgcagctggtggagtctggcgggaggcttggtccagccgtggggggtccctgagactctcctgtgcagcctctggattcacctttagcactattggatgagttggtccgcaggctccgagggaggcctggagtgggtggaccaaacagtaaaggaagataggaagtgagaagtctatgtggactcgtgtaggaagggccagttcatcatctaccagagacaacgccgagaacctccctgtactctagactaaatcgaaacacgcccgtagaacgtacggtacggaacgggaaccgaccgggtactaagttagttaagtttaagttggttaggttagaaaggtaacgtaaaagttaaaaaggggtcgggggaaccgtaaaccgggggtaaccctacggggtaccctaaccggttccctacccgtaacccgg

SEQ ID NO: 424170 - DNA, 569 bp, Homo sapiens
  misc_feature: GZ8MTXP02H7ERH.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctcgtggattctacctttagtcactattggatggagttggccgccaggctccgagggaaggcctggagtggggtcgaccaaacgataaaaggaagagtaggaagtgagaagtcctaagtggtggactcgtgtagaacgggccattcatcatctcagagacgaacgaccgacgtaactcccgtagtactctagactaaatcgaacagcctagacgagtacgaggacacggctagtagtattattggtgtagaagagtaaacgtaaaaggtcggggaacgacggggaaaccctggtaccaccggtctaccgtaccg

SEQ ID NO: 424171 - DNA, 579 bp, Homo sapiens
  misc_feature: GZ8MTXP02HT15Q.9.64.F09.1.454.CMB.2.raw
  modified_base (321)..(321): a, c, t, g, unknown or other
  modified_base (347)..(347): a, c, t, g, unknown or other
  modified_base (349)..(349): a, c, t, g, unknown or other
  modified_base (354)..(354): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctcctgtgcagcctctggattcactttagcactattggatgagttggtccgcaggctcgagggaggctggagtggtgccaanataaaggagatggagtgagagtctangngactntgtgaaggccgattcatcatctaccagagaacaacgcccgaagaaccttccctgtatctgacaaatgaaacacgacctaggagaggtaccgaggacgacggactagtagttaagtttagtttaggtgttaggaacgtaaagtaaacgtaaaaagggtcggggaaccgtaacggggaaaccccgtaggggttacccaacccggtttcctacccgttacctaacccg

SEQ ID NO: 424172 - DNA, 649 bp, Homo sapiens
  misc_feature: GZ8MTXP02HXHXA.9.64.F09.1.454.CMB.2.raw
  modified_base (296)..(296): a, c, t, g, unknown or other
  modified_base (362)..(362): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagcttgggttttccttgttgctattttagaaggtgtccagtgtgaggtgcagctggtggagtctggcgggaggcttggtccaggccgtggggggtccctgagactctcctgtgcagcctctggattcactttagcactattggatggagttcgggtccncaggctccgaggggagggcctggaggtgggtggccaacataaaggagatggaagtgagagtctagngtgctgtgtgaagggccgtattcatcatctcagagacaacgccgaagaccctcctgtactctagaccaaagtcgaacagccgtaggacgtacgccggaaggaaccgacgggtaccttaagttaggttaattttacgtttaggtttacgggttaagaaagggttaaacggtaaaaacgggtttaaaaaaggggtacggggggtaaccccgtaaaacggggggtaaaccccgttacgggggttaacccctacccggtttacccggttacccctttaccggaaacccccg

SEQ ID NO: 424173 - DNA, 589 bp, Homo sapiens
  misc_feature: GZ8MTXP02H2ON0.9.64.F09.1.454.CMB.2.raw
  modified_base (248)..(248): a, c, t, g, unknown or other
  modified_base (252)..(252): a, c, t, g, unknown or other
  modified_base (263)..(263): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (301)..(301): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggtttccttgtgctattttagaaggtgtccagtgtgaggtgcagctggtggagtctggcgggaggcttggtccagcctggggggtccctgagctctcctgtgcngctntgattcacttncatntgatgngtggccgcngcncgagggacggcgtggngtgggcgaccaaagaagtaaaggaagagtaggaagtgagaagtctagtgtaggctgtggtaggacgggcctatcatcactctccgagacgaaccgaaccgacgaacgtaacctcccgtagtactcgtacgaacaaagtacgaaacacgacctaggacgtacggtacggaacggacgtacgtactagttagttatttagttggtagtaggaagtaaagaaaaggttaaaacgggtacgggaaccggaaccgggtaaccgtcggtacccgtacccgttacctaccctacg

SEQ ID NO: 424174 - DNA, 566 bp, Homo sapiens
  misc_feature: GZ8MTXP02GVR93.9.64.F09.1.454.CMB.2.raw
  modified_base (312)..(312): a, c, t, g, unknown or other
  modified_base (326)..(326): a, c, t, g, unknown or other
  modified_base (410)..(410): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagactctcctgtgcagcctctggattcacctttagcactattggatgagttggtccgcaggctccgagggacggcnggagtgggtgcaanataaaggagatggaagtgaagaagtcctagtggtggactcgtgtagaaggggccgattcatcatctcagacgacaacgccgaanaacctccctagtactctagaccaaatagaaacagacctaggaagacgtacggaaggacgacgggactagtagtattagttgtgtagaagaggaaaactaaaagggtcggggacgaacggggtaacccgtggtacccaccggtctacccgtcacccg

SEQ ID NO: 424175 - DNA, 692 bp, Homo sapiens
  misc_feature: GZ8MTXP02HXTVY.9.64.F09.1.454.CMB.2.raw
  modified_base (518)..(518): a, c, t, g, unknown or other
  modified_base (539)..(539): a, c, t, g, unknown or other
  modified_base (577)..(577): a, c, t, g, unknown or other
tcagtgatacgtctcacgaccggtgctcgatttagcgcgtatacaaggggtcagagaggagccttagcccctggactcaaaggccctttccacttggtgatcagcactgagaacagaggactcaccatggaattggggctgagcttgggttttccttgttgcttattttagaaggtgtccagtgtgaggtgcagctgggtggagtctggcgggaggcttggtccaggccgtggggggtccctggagactctcctgtgcagccctctggattcctacctttagtctacttattggatggtaggttcgggtcccgccgaggcctaccggaggggaacgggccgtggggaggtggggtacggaccaaacgtaaggtaaagggaagtaggtagggtaagtaggaaggtaactccgtaagttggtacggtacttcggtgggtacggaacggggtccgtagttacattccatcccgtaccgaagacgaaccgaaccgtaccgaacgtaaccttcccgagttacnctagaacctaaatacgaaacncggacgtagggaagtcgggacgacgggtaccaacggtnttaaggtttatttacgttagttttggagttaaggaaagtaaagggttaaaacgtaaaaggggtcggggaacccgttaacggtacccgcgggttacccaccgttccttaccccgac

SEQ ID NO: 424176 - DNA, 702 bp, Homo sapiens
  misc_feature: GZ8MTXP02FINI9.9.64.F09.1.454.CMB.2.raw
  modified_base (249)..(249): a, c, t, g, unknown or other
  modified_base (258)..(258): a, c, t, g, unknown or other
tcagtgatacgtctcacgaccggtgctcgatttagcgcgtatacaagggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccagccgtggggggtccctgagactctctgtgcngcctctggnttcctacctttgctactattggtatggtaggttcgggtccgccgacggctccgaggggaacgggcccgtgggaggtggggtcggaccccaaaacgaagtaaaagggaagagtagggaaaggtaggaacgtaagtcctaagtggtaggtacttcgtgggtagggaaacggggtccgtattacgacttctattcctaccgagaaacgaccaaaccggacccgaacgaaacccttcccgtagttactaccgtacgaacctaaaatacggaaaccacgtacccgtagggaacgtaacggtacgggaacgggaaccggaaccgggtcttaaagttggttaatttagtttggtaggttaggaaaggaaaggtaaaacgtaaaaagggtcgggggtaacccggaacggggtaacccgtacggtaccgtacccgtcctacccgtctaacccg

SEQ ID NO: 424177 - DNA, 785 bp, Homo sapiens
  misc_feature: GZ8MTXP02HZNIO.9.64.F09.1.454.CMB.2.raw
  modified_base (279)..(279): a, c, t, g, unknown or other
tcagtgatacgtctcacgaccggtgctcgatttagcgcgtatacaagggggtcagagaggagccttagccctggactcaaaggccttttccacttggtgatcagcactgagaacagaggactcaccatggaattggggctgagcttgggtttttccttgttgcttattttagaaggtgtccagtgtgaggtgcagctgggtggagtcgtggcggggaggtcgttcgggtccgacggtcccggttgggggggtcccctggacgtacttcctcctggtgcncgcctcgtggacttcctacctttagcctacttattggatggtacggtttcgggtcccgccgagggtcctaccgggaagggggaacgggtccgttaggggaggttggggtacggacccaaagtaaagttaaaagggaagtaggtagggaaagtcggaaggaaagttcaagttagtcggtaggtacttcgtagggtacggaaacgggggtcctaatttccattacctactaccctaccgaaggacgaaacccaacggacccgaacgaacccttcccgtagtactcgtagaacctaaagtcgaaaccgacgtcctagggaacgtacgggtaccggaaacgggaccgtaacgggtacttaaggtttagtttaagtttttaggttaggttaggttaaggtaaaccgggtaaaaggttaaaaccggggttaaaaagggggttcgggggaaaccccgaaaacgggggttaacccccttacggggtaaccccgtaccggtttaccctaccccgg

SEQ ID NO: 424178 - DNA, 548 bp, Homo sapiens
  misc_feature: GZ8MTXP02HG36A.9.64.F09.1.454.CMB.2.raw
  modified_base (455)..(455): a, c, t, g, unknown or other
  modified_base (480)..(480): a, c, t, g, unknown or other
tcagtgatacgtctcacgaccggtgctcgatttagcgcgtatacaaggggctcagagaggagccttagccctggactcaaaggcctttccacttggtgatcagcactgagaacagaggactcaccatggaattggggctgagcttgggttttccttgttgcttattttagaaggtgtccagtgtgaggtgcagctggtggagtctggcgggaggcttggtccaggcccggttggggggtccctggacgactctcctgtgcagcctctggattcaccttagtcactatgatggaggttcggtccgcgaggcctccggaaggggacggccgtggaggtgggtacgaccaagaagtaaaaggagagtaggaagtgaagatctatggagctgtgtacgaggtccgatcatcatcacagacacgacgacgacaacctcctagtatctagacaatcgaacngtaccagagagtacgacgacacgtntatgttagttatcgtagtagaagagaaacgtaaagggcggacgaacggaccgtggcctacgtctaccg

SEQ ID NO: 424179 - DNA, 547 bp, Homo sapiens
  misc_feature: GZ8MTXP02I5IIN.9.64.F09.1.454.CMB.2.raw
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcacatcacttgcccgtccactcagagtatgagttacttggttggcctggtatcagcaagaaaccgaggaaacgacccctaaactcctaatctatgatcgcctcctagttttagggaaaggttcggggtacccattcgaaggttcaaggccgacgaggtggatcgtaggggacaggtaacttcactccacacataccagtcacgcctagcagcctgattgtatttcgactaactttatactagaccaacgacattaacgtggtacttccggaccgtaggaaccaagtcgtatagaacaaacgtatcgtcggactcgccaacgtcgtctcgttactctactcctttaccc

SEQ ID NO: 424180 - DNA, 775 bp, Homo sapiens
  misc_feature: GZ8MTXP02G424X.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctgggtggagtcgtggcggggaggtcttgggtccaggcccgtggggggtccctgagtactctccgtgtgcagcctcgtggtacttctacctttagtctacttagttggattggtaggttcggggtaccccgccgaagggtcctacccggaagggggtaaacggggtcccgtaggggtacggtggggtacggaccccgaaaagaaggtaaaaagggaagtaagttaggggaaaaggttggaaaccggtaacggttcctaaggtcggtacggtaaccttcgtggggtacgggaaacgggggtcccgtaatttccgaactacctaacgttccctacccgaaaggaacgaaacccgaaaccggaccccggtaaacgtaaacccccgttccccgttaggttacttaccggttacgaaaccctaaaagttaccgaaaaccgtacgaccgttagggaacgtaacggtacggaacggaacgacggacttagttagttaatttcgttgtagtacgaaggtaacgtaaacggtaaaagggtcgggaaccgaacgggtaaccgtacgggtaccctaccggtcctacccgtacgacccg

SEQ ID NO: 424181 - DNA, 702 bp, Homo sapiens
  misc_feature: GZ8MTXP02JJIZQ.9.64.F09.1.454.CMB.2.raw
  modified_base (193)..(193): a, c, t, g, unknown or other
tcagtgatacgtctcacgaccggtgctcgatttagcgcgtatacaagggggggagtcagactcagtcaggacacagcatggacatgagggtccccgctcagctcctggggctcctgctgctctggctcccaggtgccaaatgtgacatccagatcgacccagtcctccttccacctgtctgcatctgtagganacagagtcaccatcacttgcccgtcactcagagtagtgagttacgttggttcggcctggtactcagacaacggaaaccgagggaaacctacccctaaatcctaatctatgatcgcctacgtagtttaggaaacgttcgggtacctagtacgtaaaggttcgacggacccggctaggtcgtagtcggtaggactagtacttcacttcctacactatcgaacgctacgtccctagtaccgcgtacctagtacgtttacgtttacgttttacgaacctttaaacgtttacgttaaccgtacggtaaccccttaaaccgtacctttaaacgtttaaaccggtttacgggttaacccgttttccccggggaacccgttaacggggtaaaacccgttaaagttacgggtaaaagtttaccgaaaaccgtaaaaccggtaacgttacgggtcgttaccgacgtacccgtaactacgttccgttacgtacctttaccgtacgtttccccttaacccg

SEQ ID NO: 424182 - DNA, 578 bp, Homo sapiens
  misc_feature: GZ8MTXP02IVD6G.9.64.F09.1.454.CMB.2.raw
  modified_base (297)..(297): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccaggccgtggggggtccctgagacctctcctgtgcagcctctggattcacctttagcactattggatgagttgggtccnccaggctccgagggaggcctggagtgggtgacccaaagaagtaaaggaagagtagggaagtgagaagtcctagtggtggactcgtggtaggaaggggccgtattcgatcatctaccgagagacaaacgccgaacgaacctccctgtactcgtgacaaatcgaacagcctagagagtacgaggacaggactagtagttattagttgtgtagaacgtagtaaaacgtaaaagggtcggggaaccgaacgggtaaacccgtggttaccaccgtctaccgtaccg

SEQ ID NO: 424183 - DNA, 742 bp, Homo sapiens
  misc_feature: GZ8MTXP02G1X9Z.9.64.F09.1.454.CMB.2.raw
  modified_base (588)..(588): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgcttattttagaaggtgtccagtgtgaggtgcagctgggtggagtcgtggcggggaggtcgttgggtccgaggtcccggtcgggggggtcccctggacgtaccttccttccgttggtcgccacgtcccttcgtggtatttccaaccttttagtccacttagttgggaattggtaggtttcggggtcccgacccgagggccttacccggaaagggggaacggggtccccgttggggaagggttcgggggtcggacccgaaaacgtaaaggttaaaaggggaaagtaggtaaggggaaagtggaaagtaacgttcctaagtgggtacggtacttcgtgggtaggaacggggtcctatttcgatctactccacctaagacgaaccaacgaccgaacgaacctcccgtagtactctagactaaaagtcgaacgngtaccgtagacgtaggacggaaaggaccgacggtaactagttacgttaagtttagttggttaggtaggtaagtaaacggtaaaggtaaaaacggggtcggggaacccgtaaacgggaacccggttcggaccgtacccgttccgtaccggtaccg

SEQ ID NO: 424184 - DNA, 530 bp, Homo sapiens
  misc_feature: GZ8MTXP02IPDON.9.64.F09.1.454.CMB.2.raw
  modified_base (374)..(374): a, c, t, g, unknown or other
  modified_base (528)..(528): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggtccagcctggggggccctgagactctcctgtgcagcctctggattcacctttagtcactattggatgagtttcgggccgccaggctccgaggggaagggcctggaggtgggtggccaacagtaaaaggagatggaagtgagaagtcctatgtggacttcngtgaagggccattcatcatctcagagacacgcagactccctagtatcagacaaatagacagccagagagacgaggacgacggactatagtatttaattgtgttgagagaagtaaaagtaggacgaacggaccgtacggtcgtcggtctcctccncg

SEQ ID NO: 424185 - DNA, 596 bp, Homo sapiens
  misc_feature: GZ8MTXP02FRK2Q.9.64.F09.1.454.CMB.2.raw
  modified_base (301)..(301): a, c, t, g, unknown or other
  modified_base (329)..(329): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtcgtggcgggaggcttgggtccaggccgtgggggtccctggagctctcctgtgcagcctcgtggtattcacctttagtcactagttggatgagttcgggccncgaggctccgagggaggctggagtgggngacaaagagtaaaggaagagtaggaagtgaagtagtcctaagtcgtaggtactgtagaggaaacgggccgtaatttcattcactctaccagaacgacaaaccgaccgaacgtaacctcccgtagtactctagaacaaatacggaaacacgaccgtagaacgtaggtacggaaggtacaccggatatgttaactttagttagtgtagagtaacgaaagtaaaagggtcggaacggtaacggaccgtacggtcctaccgtcctactccg

SEQ ID NO: 424186 - DNA, 707 bp, Homo sapiens
  misc_feature: GZ8MTXP02IN2H1.9.64.F09.1.454.CMB.2.raw
  modified_base (307)..(307): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctgggtggagtcgtggcggggaggcttgggtccaggcccgtggggggtccctgacgtactcctcctgtcgcagtcctgtggtattcacctttagtcactattggatggagttcggtccncacggctccgaggggaggccgtggaggtgggtggaccaaacgaagtaaaaggaagtagtaggaaaggtgaacgtaacgttacctagttaggtcggaaccttcgtggggtacgaaacggggccgtaattccatctaatcctacagacgaacaacgaccgaactaccgtcctagtactacgtacgaacaaagttacgaaactacgacccgttaggaacggtacggtaccggaaagggtacccgaacgggtacgttaagtagtttaagtttagttaggttaggtaggtaaacgtaaagggtaaaaggttaaaaaacggggtcgggggtaaaccccggtaaacggggttaaacccgttacgggtacccgtacccggtttaccctacccgttaccgtaaccccgg

SEQ ID NO: 424187 - DNA, 610 bp, Homo sapiens
  misc_feature: GZ8MTXP02G5DPG.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggtttcctgttgctattttagaggtgtccagtgtgaggtgcagctgggtggagtctggcgggaggcttggtccagccgtggggggtccctgagactctcctgtgcacgcctctggacttcacctttagtcacttattggatgaggttcgggtccgccgaggctccgaggggacgggccgtgggaggtggggtcggaccaaacgaagtaaacggaagagtaggaagtagaagtaagtcctagtgtggactgtggtagagggccgtatccatcatctcagacacgaacgccgaacgtacctccgtagtactcgtacgacaaagtacgaacagaccgtaggaagacggtcggacggaacgacggtactagtgttatttagttagtgtagtaggaacgtaaaggtaaaacggtcggggaaccgtaacgggtacccgtacggtaccgtaaccggttcctaccgtacgtacccg

SEQ ID NO: 424188 - DNA, 583 bp, Homo sapiens
  misc_feature: GZ8MTXP02JVGTS.9.64.F09.1.454.CMB.2.raw
  modified_base (257)..(257): a, c, t, g, unknown or other
tcagtgatacgtctcacgaccggtgctcgatttagcgcgtatacaaggggtcagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctgcgggaggcttggtccaggccgtggggggtccctgagactctcctgtgcagcctntggattcactttgcactatggatgagttgggtccgcaggctccgaggggaggcctggagtggggtgccaacgataaaggaagatggaagtgagagtcctagtgtggactctgtaggaaaggggccgattcgatcatctcagagacaacgcgacgactcctgtactctagacaaatgaacacgcctagaggacggtacggaacggaccgaacgggacttaagtggttaactttagttggtagttaggaagaacggtaaagtaaaaacgggttgggggaaccgacggggtaacccgtacgggtaccgacccggttacctccgtacccg

SEQ ID NO: 424189 - DNA, 682 bp, Homo sapiens
  misc_feature: GZ8MTXP02IW38Y.9.64.F09.1.454.CMB.2.raw
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcggggaggtcttggtccaggccgtgggggtccctgagactctcctgtgcagcctgtggtacttctactttagtcacttagtggatgtagttcggtccgccaggctccgaggggtaacggcgtggaggtggggtcgaccaacgaagtaaaggagagtggaaaggtgagtacgtctagtgtggaccttgtggttaggaaacggggtcctagttcacgtactactcgtccgaagacgaacgaacgaccgaagtaccctaccgttgtactacgacgactaaagtagaaacgtagtaccgtaggaacgtacggtacggaacggtaccggaacgtacgttacgtagttaacgtttagttaggttaggtaggtaaaggtaaaggtaaaacggtaaaaaacggggtccggggtaaaccggtaaaccggggtaacccggttacggtaccccgtacccggttacccgttaaccgttaccgtaaaccccgg

SEQ ID NO: 424190 - DNA, 771 bp, Homo sapiens
  misc_feature: GZ8MTXP02FI9EJ.9.64.F09.1.454.CMB.2.raw
tcagtgatacgtctcacgaccggtgctcgatttagcgcgtatacaaggggtcagagaggagccttagccctggactcaaaggcctttccacttggtgatcagcactgagaacagaggactcaccatggaattggggctgagcttgggttttccttgttgctattttaggaaggtgtccagtgtgaggtgcagctgggtggagtctggcgggagacgttggtccaggcccggtggggggtccctggacgacctcctccgtgtcgccacgcctgtggtacttcttacctttagtcacgttagtggtagtaggtaggtttccggggccgaccggacgggtcccgtaccgggggaaggggggaaccggggtcccggtagggggtacggggttacgggggtaaccggaaaccccgaaaaggtaaaagggtaaaaagggaaggtaaggtaaacggggtaaaggtaggtaaacggtaacgttaccgttaggtggtaccggtacgtttcggtagggtaacggggaacgggtccgtaattcaacttctaactccgtaaccgaagaaaccgtaaccgaacggacccgaacgtaaaccctccttagtaactcgtaagaaactaaacgtacaacgtacgtacgtaggaaacggtacggtacggaaacggacgtacggtattaagttagtttagttagttggtacggtagaaagtaaacgtaaaggtaaaggggtccggaaccggtaacgtaccggtacgtaccgtaccgttccgaccgtaccg

SEQ ID NO: 424191 - DNA, 593 bp, Homo sapiens
  misc_feature: GZ8MTXP02I5S8Y.9.64.F09.1.454.CMB.2.raw
  modified_base (249)..(249): a, c, t, g, unknown or other
  modified_base (253)..(253): a, c, t, g, unknown or other
  modified_base (271)..(271): a, c, t, g, unknown or other
  modified_base (282)..(282): a, c, t, g, unknown or other
  modified_base (298)..(298): a, c, t, g, unknown or other
  modified_base (300)..(300): a, c, t, g, unknown or other
  modified_base (305)..(305): a, c, t, g, unknown or other
  modified_base (309)..(309): a, c, t, g, unknown or other
  modified_base (323)..(323): a, c, t, g, unknown or other
  modified_base (343)..(343): a, c, t, g, unknown or other
  modified_base (355)..(355): a, c, t, g, unknown or other
tcagtgatacgtctcacgaccggtgctcgatttagcgcgtatacaaggggagagaggagccttagccctggactcaaaggcctttccacttggtgatcagcactgagaacagaggactcaccatggaattggggctgagctgggttttccttgttgctattttagaaggtgtccagtgtgaggtgcagctggtggagtctggcgggaggcttggccagccgtggggggtccctgagtactctctgtgcngctngattcactttgcatatgntgagttggtcncgagctcgaggaggcngngtggngcanataagagatgaagngagagtctatgtgactgtgngaaggctatcancatctacagagacacgcgactaacctccgtagtacgtctgaacaattacgaaacgcacccgtagggacgaacggtacgggaaggaacccgtaacggtacttaagtagtttaattaggtttaggttagggtaacgtaaaggtaaaagtaaaaccggttaaaaagggggttcggggaacccggtaaacggggaacccgttacgggtacccgtaaccgttcccgtactacccggtaacccg

SEQ ID NO: 424192 - DNA, 608 bp, Homo sapiens
  misc_feature: GZ8MTXP01BZ4G7.21.37.D04.1.454.CMB.2.raw
  modified_base (434)..(434): a, c, t, g, unknown or other
  modified_base (460)..(460): a, c, t, g, unknown or other
tcagtcgtcgctcgcacgaccggtgctcgatttagtagcatactgttgggtttggggggaagaggaagactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatacacctttactagttatgctatgctattgggtgccgccaggcccccggagaagggcttgagtggagtgggatggctccacgctggcaatggttaacaactaaaaatattacaacagaagttccgaggcagagtcccaccataccgagggacaacatccgacgagtacacgcctaacagtggagctaggagcagcctagacgtatcgngacgaacagtactagtaatatttacngtgcgaggataagtcaggccctcccccgtgtaaccgtacgggttacgtaaccgttacgggttcgtcgttttacggttattacgtcgggttaaccgggggaacctaaaacgggggacttaaacggttcgggttaaccccttaaccccgg

SEQ ID NO: 424193 - DNA, 595 bp, Homo sapiens
  misc_feature: GZ8MTXP01AK3H9.21.37.D04.1.454.CMB.2.raw
  modified_base (536)..(536): a, c, t, g, unknown or other
tcagtcgtcgctcgcacgaccggtgctcgatttagtagcatactgttgggtttgggggaagaggaagactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatactactttactagttatgctatgctagttgggtgcgccacggcccccggagaaggcttgagtggatgggatggctccgacgctggacaagtggttaacaactaaaatacttcaacaagtaacgttccgagggccaggacgtaccaaccattacccgaggaccaacactcccgacgaagtaccacgtcctacagtagggagctgagcagcctaggacgatcgagacgacgacgtctaagtatattactggtgcgagagagttccgacggtcccctccccgtgtaaccgtacgggttcgtaccgttacggtnttacgttttcgacttcgtcggtgggaaccgtaagggaccttaggtcgttccgtaacccg

SEQ ID NO: 424194 - DNA, 547 bp, Homo sapiens
  misc_feature: GZ8MTXP02IURW3.21.37.D04.1.454.CMB.2.raw
  modified_base (258)..(258): a, c, t, g, unknown or other
  modified_base (274)..(274): a, c, t, g, unknown or other
  modified_base (391)..(391): a, c, t, g, unknown or other
  modified_base (445)..(445): a, c, t, g, unknown or other
tcagtcgtcgctcgcacgaccggtgctcgatttagtagcatactgttgggtttgggggaagaggaagactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatacacctttactagttatgctatgcattgggtncgccaggcccccgganaagggcttgagtggatgggatggctccacgctggcaatggtacacaaaatattcacagagttccagggcagagtccaccattaccaggacacatccgcagtacagcctacatggganctgagcagcctgagatctgacgacacggtctaatattattactgtgacgagagntcaggtccctcccccgtgaccgtacggtgaccgttacggtcgtaccgttttagattagtcgttagggggacccaaagggggacctaaagtcggtactacccg

SEQ ID NO: 424195 - DNA, 612 bp, Homo sapiens
  misc_feature: GZ8MTXP02G3AIQ.21.37.D04.1.454.CMB.2.raw
  modified_base (276)..(276): a, c, t, g, unknown or other
tcagtcgtcgctcgcacgaccggtgctcgatttagtagcatactgttgggtttggggggaagaggaagactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatacacctttactagttatgctatgctagttggtgcgccaggcccccgganaagggcttgagtggagtggatggctccacgctggcaatggttaacaacaaaatattacacagaagttcccaagggcaagacgtccaccattaccagggacacgatccgacgaatacacgcctaacagtggaagctagagcacgcctagagattcagacgacgacggtctaataagtattactggtacgacgagagtacgtacgacggtacccacccccgtagtaccgtaaccgggtcgtaaccgttaaccgggttgttaccgtttttacggaatttacgtaaccggttacggggaccgaaaacggggtacctaagtaccgggtaccttaaccccgg

SEQ ID NO: 424196 - DNA, 546 bp, Homo sapiens
  misc_feature: GZ8MTXP02FTS9R.21.37.D04.1.454.CMB.2.raw
  modified_base (329)..(329): a, c, t, g, unknown or other
  modified_base (394)..(394): a, c, t, g, unknown or other
tcagtcgtcgctcgcacgaccggtgctcgatttagtagcatactgttgggtttggggggaagaggaagactgacggtccccccaggagttcaggtgctgggcacggtgggcatgtgtgagttttgtcacaagatttgggctcaactctcttgtccaccttgtgcagtctggggctgaggtgaagaagcctggggcctcagtgaaggtttcctgcgaggcttctggatacacctttactagttatgctatgcagttgggtgcgccacggccccccggacaagggcttgagtggatgggatggctccacgctggcaatggtacacaaaatntcacagaagttccaggcagagtccaccataccaggacacatccgcgagtacacgcctacatgganctgagcagcctgagtatctgacgacacggctatatattactgtgcgagagatcgacggcctcccccgtagaccgtacggtcgaccgtacggtcgtcttttagattacgtcggtacggggaccgaaacgggactaaacgtcggtacctacccg

SEQ ID NO: 424197 - DNA, 515 bp, Homo sapiens
  misc_feature: GZ8MTXP01ES1DY.51.27.C05.1.454.CMB.2.raw
  modified_base (320)..(320): a, c, t, g, unknown or other
  modified_base (363)..(363): a, c, t, g, unknown or other
  modified_base (481)..(481): a, c, t, g, unknown or other
tcagcgatcgtatacacgaccggtgctcgatttagacgcgatcgaagggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttatgatgtcagtgatcggccctnagggggtttcaatcgcttctcctggctccaagtcccggcaacncggcctccctgaccatctctgggctcaggccgagacgaggctgattatactgcacctcatatacaagcagcaacaattgggtgttcggcggagggccaagcttgacgttcctaggtcngcccaaggctgcccctggtcactcttgttccccg

SEQ ID NO: 424198 - DNA, 525 bp, Homo sapiens
  misc_feature: GZ8MTXP01B4V1A.51.27.C05.1.454.CMB.2.raw
  modified_base (519)..(519): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtacaacaccacccaggcaaagcccccaaatcatgatttatgatgtcagtgatcggccctgaggggtttcaatcgccttctctggctccaaagtcccggcaaacaccgggcctcccctgaccatctctgggcctcgaggccgaggacgaggctgattatactgcacctcatatacaaagcagcaaacaattgggtgttcgggcggaagggaccaagcttgaccgtcaggttcacgcccaggctcgccccttggtccncgtccg

SEQ ID NO: 424199 - DNA, 511 bp, Homo sapiens
  misc_feature: GZ8MTXP01DW240.51.27.C05.1.454.CMB.2.raw
  modified_base (306)..(306): a, c, t, g, unknown or other
  modified_base (364)..(364): a, c, t, g, unknown or other
  modified_base (376)..(376): a, c, t, g, unknown or other
  modified_base (502)..(502): a, c, t, g, unknown or other
  modified_base (506)..(506): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccacccaggacaaacgcccccaaatcatgatttangatgtcagtgactcggcctgaggggtttcaatcgcttctctgctcaaagtccgcaacncgcctcctgacntctctggctcgaggccgaggacgaggctgattatactgccactcatatacaagcagcaaactagttgggtgttcgggcggaagggaccaaggcttgaccgtcaggttcacgcccaggctcgccccngtcncgtcc

SEQ ID NO: 424200 - DNA, 553 bp, Homo sapiens
  misc_feature: GZ8MTXP01ECRDP.51.27.C05.1.454.CMB.2.raw
  modified_base (427)..(427): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgtttcctgtatcaacagaagcaggccagtcccctgtcgtgtcatctatcaagacaccaagccggccctcgagggactcccgtgagcgtattccctctggcctccaactcgtagggaacacacgcccactctacgaccatccgaggcgggacgcgaggctagtggatggagtctgtacttttacgnggtcgaggcgtgggacagcgacacgtcggccggtggtccgggcgggggaaccaaggctcggaccgtccgtcggttcgcgacccgaacggcctccgcccccgtcggttcctaaccgttcgttccccg

SEQ ID NO: 424201 - DNA, 545 bp, Homo sapiens
  misc_feature: GZ8MTXP01A8UIW.51.27.C05.1.454.CMB.2.raw
  modified_base (305)..(305): a, c, t, g, unknown or other
  modified_base (468)..(468): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataatatgtctctggtaccaacaccacccaggcaaacgcccccaaactcatgatttangatgtcagtgatcggccctcgaggggtttcaatcgccttctctggctccaaagtcccggcaacacggcctccctgaccatcctctgggctcgaggccgaggacgaggctgattatactgcactcaatatacaagcagacaaacaagttggggtagttccgggnggaaggggacccaaaggccttggaacccgtccttagggccacgcccaaggcctcgcccccgttggtccaacgttccg

SEQ ID NO: 424202 - DNA, 513 bp, Homo sapiens
  misc_feature: GZ8MTXP01CTOZA.51.27.C05.1.454.CMB.2.raw
  modified_base (311)..(311): a, c, t, g, unknown or other
  modified_base (336)..(336): a, c, t, g, unknown or other
  modified_base (359)..(359): a, c, t, g, unknown or other
  modified_base (370)..(370): a, c, t, g, unknown or other
  modified_base (415)..(415): a, c, t, g, unknown or other
  modified_base (480)..(480): a, c, t, g, unknown or other
tcagcgatcgtatacacgaccggtgctcgatttagacgcgatcgaagggtttgggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctnagggactcccctgagcgatttcccnctggctccaaactctagggaacncagcccactcncgaccatcagcggacgcaggctgtggatgaggctgacttttacgnggtcaggcgtgggaccaggcacacgtgccgtgtcgggcggggcaagctcgaccgtccgcgttcgngcccaaggctcgccccgtgcctcgttcgtcccg

SEQ ID NO: 424203 - DNA, 523 bp, Homo sapiens
  misc_feature: GZ8MTXP01ACO88.51.27.C05.1.454.CMB.2.raw
  modified_base (301)..(301): a, c, t, g, unknown or other
  modified_base (337)..(337): a, c, t, g, unknown or other
  modified_base (353)..(353): a, c, t, g, unknown or other
  modified_base (417)..(417): a, c, t, g, unknown or other
  modified_base (472)..(472): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccaccaggcaaacgcccccaaatcatgatttangatgtcagtgatcggcctgagggtttcatcgcttcntgctcaagtccgcacncggcctcctgaccatctctgggcctccgaggccgaggacgaggctgattatactgcactcatanacaagcagcaacagttggggagttcggcgggaagggaccaggcttgacccgtcgnggttccacggcccgaaggcctcggtcccccttcggttcccaacgtttcccg

SEQ ID NO: 424204 - DNA, 534 bp, Homo sapiens
  misc_feature: GZ8MTXP01B211A.51.27.C05.1.454.CMB.2.raw
  modified_base (309)..(309): a, c, t, g, unknown or other
tcagcgatcgtatacacgaccggtgctcgatttagacgcgatcgaagggtttgggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtgtcatctatcaagacaccaagcggccctnagggactccctgagcgattcctctggctccaactctgggaacacagccactctagaccatcagtcgggacgcgaggctgtgggatggaggctgtacttttacgtgggtcagggtcgtggggacagcgacacgtcggtccgtggttcgggcgggggaacaacggcgtcgaccgtccgtcggttcgcgcccgaaggccgtcgccccgtcggttcctccgttctcccg

SEQ ID NO: 424205 - DNA, 637 bp, Homo sapiens
  misc_feature: GZ8MTXP01E3B9H.51.27.C05.1.454.CMB.2.raw
  modified_base (366)..(366): a, c, t, g, unknown or other
tcagcgatcgtatacacgaccggtgctcgatttagacgcgatcgaagggtttggggggcctcaggaagcagcatcggaggtgcctcagccatggtatggatccctctcttcctcggcgtccttgcttactgcacaggatttgtggcctcctatgagctgactaagccaccctccgtgtccgtgtccccaggacagacagccagcgtcacctgctctggggataaattgcgcgatagatatgtttcctggtatcaacagaagccaggccagtcccctgtcgtggtcatctatcaaagacaccaagcggccctcgagggactcccgtgagcgattctctcggcctaccaactcgtagggaaaaccacncgcccactctacgacccatcgaggccgggatggacgaggcgtggtaggagtggaggtcgtagttacttttagcggtcgggacgggtcgggtagggacgacggcgaccgtacgtccgggtccggttcggggtccgggggaccgggggaacccaacgggtccgttaccgggaccccgttcccggtaccgggtccgacccggcccggacggcccgtccccggtcccccggttcgggtcccttacccgtttccccgttccccgggttcccccccg

SEQ ID NO: 424206 - DNA, 514 bp, Homo sapiens
  misc_feature: GZ8MTXP01A658X.51.27.C05.1.454.CMB.2.raw
  modified_base (363)..(363): a, c, t, g, unknown or other
  modified_base (376)..(376): a, c, t, g, unknown or other
  modified_base (509)..(509): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaacgcccccaaactcatgatttatgatgtcagtgatcggcctcgaggggtttcaatcgcttctctgctcaaagtccgcaacncgctccctgaccntctctgggcctcgaggccgaggacgaggctgattatactgcacctcatatacaagcagcaaacaagttggggtgttcgggcggaagggaccaagcttgaccgtcaggttcaggcccaggctcgccccttggcncgtcg

SEQ ID NO: 424207 - DNA, 591 bp, Homo sapiens
  misc_feature: GZ8MTXP01BY7VL.51.27.C05.1.454.CMB.2.raw
  modified_base (228)..(228): a, c, t, g, unknown or other
  modified_base (302)..(302): a, c, t, g, unknown or other
  modified_base (507)..(507): a, c, t, g, unknown or other
  modified_base (582)..(582): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctctgcactggaaccngcagtgacgttggtgttataattatgtctctgtaccaacaccaccagacaaacgcccccaaatcatgtatttangatgtcagtgatcggcctgagggtttcaatcgtcttctgtcgcctccgaaagtcccggcaaaccgaccggccctcccgtacgacctacttcctcgtcgggcctaccggacgggacccggaagggacgtacgggcttaggtattaacttacgtgaccctacgtacaataactacgaaagcaagaccaaagtagttgggtgtcgggnggaacggggaacaaggcttacgacccgtcgttacggttcacgaacccgaggtccgtcccgcccccgttggtcccnccgttcccg

SEQ ID NO: 424208 - DNA, 640 bp, Homo sapiens
  misc_feature: GZ8MTXP01BXJ25.51.27.C05.1.454.CMB.2.raw
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccacctatcctctgacctacgtacgaaccagctagtgtacggttggttagttaattaattgtcgtcctcgtacgaaccaacacccaccgaggaacaaccgacccctaaatcatagttatttagagatgtacgaggtgaccgtcccggtccttagggtacgggtttacactccgttccttcgtcgtcggtcctaccgaaacggtcccgaacaaccgtcccgtcccttcccgacactctcctcggcggtcctaccggacgggaccggaggaccggaggtctagttattacttacgactacctacgtataactaacacgaagacgacgaactaaacgttggttcggggtacgtcgggacgggaacgacgagtcgttacgtaccgtcgttagcgaccgaaccgacgtcctcccggtcccgttacgtcttccgtcccg

SEQ ID NO: 424209 - DNA, 540 bp, Homo sapiens
  misc_feature: GZ8MTXP01EJV6A.51.27.C05.1.454.CMB.2.raw
  modified_base (227)..(227): a, c, t, g, unknown or other
  modified_base (301)..(301): a, c, t, g, unknown or other
  modified_base (362)..(362): a, c, t, g, unknown or other
  modified_base (379)..(379): a, c, t, g, unknown or other
  modified_base (525)..(525): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctggtaccaacaccaccaggacaaacgccccaaatcatgatttangatgtcagtgatcggccctgtaggggtttcaatcgcttctctggctcgaagtccgacaacncggcctcctgaccatcncgtcgggctcgaggccgaggacgaggactgtattatactgactactcatactacaaagcagacaactaaggttgggtcgttcgggacggacgggaccaagcttaggacccgttcgtagggcacgcccaaggctccgcccgttcgcncctcttcgtaacccc

SEQ ID NO: 424210 - DNA, 600 bp, Homo sapiens
  misc_feature: GZ8MTXP01CJOJ9.51.27.C05.1.454.CMB.2.raw
  modified_base (303)..(303): a, c, t, g, unknown or other
  modified_base (444)..(444): a, c, t, g, unknown or other
  modified_base (458)..(458): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccaacaccaccagacaaacgccccaaatcatgatttangatgtcagtgatcggcctgtagggttcaatcgtccttctcgtggcctaccgaaaacggtcccggaacaaaccgaccggccctcccctgaaccctatcctcgtcgggcctccgaggccgaggacgacggctagtattatacngacacctcaattanaacaagcaacgactaaactaggttgggtacggttccgggacgggaacggggaacccaaaggccttacggtaaccccgttcgttacggttccgacgaaccccgaagggtcctacccgcccccgttcggtcccaacgtttcccg

SEQ ID NO: 424211 - DNA, 526 bp, Homo sapiens
  misc_feature: GZ8MTXP01DMTWJ.51.27.C05.1.454.CMB.2.raw
  modified_base (307)..(307): a, c, t, g, unknown or other
  modified_base (347)..(347): a, c, t, g, unknown or other
  modified_base (430)..(430): a, c, t, g, unknown or other
  modified_base (520)..(520): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaatcatgatttangatgtcagtgatcggccctgaggggtttcaatcgcttctntggctccaaagtccgcaacacgccctccctgaccatctctggctccgaggccgaggacgaggctgattatactgcactcatanacaagcaagacaaacgtaagttggggtgttcgggcgggaagggacccaaagcttagaccgtcaggttcacgccagctcgccccttgtccncttccg

SEQ ID NO: 424212 - DNA, 529 bp, Homo sapiens
  misc_feature: GZ8MTXP01B0EWC.51.27.C05.1.454.CMB.2.raw
  modified_base (363)..(363): a, c, t, g, unknown or other
  modified_base (420)..(420): a, c, t, g, unknown or other
  modified_base (424)..(425): a, c, t, g, unknown or other
  modified_base (430)..(430): a, c, t, g, unknown or other
  modified_base (436)..(436): a, c, t, g, unknown or other
  modified_base (515)..(515): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggacaaacgccccaaatcatgatttatgatgtcagtgactcggccctgaggggtttcaatcgcttctcctggctcgaagtccggaacaacnccggccctccctgacctatcctcgtcgggcctcgagggccgaggacgaggctgattntacnncactnatacanagacagacaagtagttgggtgtcggacggacggacaagcttcgaccttcgtacgcacgccgagcctccgcccgtcgtcnctccgttccgtccc

SEQ ID NO: 424213 - DNA, 583 bp, Homo sapiens
  misc_feature: GZ8MTXP01BX7UF.51.27.C05.1.454.CMB.2.raw
  modified_base (575)..(575): a, c, t, g, unknown or other
tcagcgatcgtatacacgaccggtgctcgatttagacgcgatcgaagggtttgggggctggggtctcaggaggcagcgctctcgggacgtctccaccatggcctgggctctcgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccaacaccaccaggcaaacgcccccaaactcatgatttatgatgtcagtgactcggcctcgtaggggtttcaagtcgccttctcgtggcctaccgaaacgtcccggctaaaccgaccggtccctcccgtgaccattcctcgtcgggcctcgagggccggaggacgaggtcgtagtattactactgcctaccgtactataactaacaaagcaacgactaaacgtaaggttgggtacggttcgggacgggaacgggacaaggcgttcggaccgtcgttacggttcacgccgagcgtcgccccgttcggtcncgttcccg

SEQ ID NO: 424214 - DNA, 522 bp, Homo sapiens
  misc_feature: GZ8MTXP01E4WOM.51.27.C05.1.454.CMB.2.raw
  modified_base (305)..(305): a, c, t, g, unknown or other
  modified_base (466)..(466): a, c, t, g, unknown or other
  modified_base (518)..(518): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccacccaggcaaagcccccaaatcatgatttangatgtcagtgatcggccctcgaggggtttcgaatcgccttctctggctccaaagtcccggcaaacacggccctccctgaccatctctgggctccgaggcccgaggacgaggctgattatactgcactcatatacaagcagcaaacaattggggtgtcgggnggaagggaccaagcttgaccgtcaggttcagcccaggctcgccccttggtcnctcg

SEQ ID NO: 424215 - DNA, 551 bp, Homo sapiens
  misc_feature: GZ8MTXP01AHSKD.51.27.C05.1.454.CMB.2.raw
  modified_base (543)..(543): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatattatgtctctggtaccaacaccacccaggcaaacgcccccaaactcatgatttatgatgtcagtgatcggcctcgaggggtttcaatcgccttctctggctccaaagtccggcaacaccggcctccctcgaccatctctgggcctccgaggccgagggacgagggctagattacttactcgccacctcaatactaacaaagcacgacaaacgtaagttggggtcgttcgggcgggaagggaccaaggcttcgaccgtcgaggttcacgcccaggcctcgccccttcggtccncgttcccg

SEQ ID NO: 424216 - DNA, 492 bp, Homo sapiens
  misc_feature: GZ8MTXP01C8323.51.27.C05.1.454.CMB.2.raw
  modified_base (201)..(201): a, c, t, g, unknown or other
  modified_base (302)..(302): a, c, t, g, unknown or other
  modified_base (352)..(352): a, c, t, g, unknown or other
  modified_base (356)..(356): a, c, t, g, unknown or other
  modified_base (365)..(365): a, c, t, g, unknown or other
  modified_base (398)..(398): a, c, t, g, unknown or other
  modified_base (402)..(402): a, c, t, g, unknown or other
  modified_base (436)..(436): a, c, t, g, unknown or other
  modified_base (448)..(448): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggtgttataattatgtctctgtaccaacaccacccagcaaagcccccaaatcatgatttangatgtcagtgatcgcctgagggtttcatcgcttctctgctcaaagtccgnaacncggcctccngacatctctggctcagccgagacgagctgattntacngcactcatatacaagcagcaacagtggtgtcggnggaaggacagcngaccgtcttaggttcacgccaagcctcgccccttgtccgctccg

SEQ ID NO: 424217 - DNA, 541 bp, Homo sapiens
  misc_feature: GZ8MTXP01AHIMF.51.27.C05.1.454.CMB.2.raw
  modified_base (250)..(250): a, c, t, g, unknown or other
  modified_base (437)..(437): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctcctggtaccaacaccacccaggcaaacgcccccaaactcatgatttatgatgtcagtgatcggccctcgaggggtttcaatcgcttctcctggctaccgaagtccggaccaaaccgcggccctccctgacccatctcgtcgggcctccgaggccgaggacgaggctgattatactgcacctnaatatacaagcaagcaacgtaagttgggtgttcggacggtagggaccaagcttggaccgttcgtaggcagccaaggcctcgcccctggcactccgttcgtcccc

SEQ ID NO: 424218 - DNA, 620 bp, Homo sapiens
  misc_feature: GZ8MTXP01D89BP.51.27.C05.1.454.CMB.2.raw
  modified_base (232)..(232): a, c, t, g, unknown or other
  modified_base (293)..(293): a, c, t, g, unknown or other
  modified_base (363)..(363): a, c, t, g, unknown or other
tcagcgatcgtatacacgaccggtgctcgatttagacgcgatcgaagggtttggggggcctcaggaagcagcatcggaggtgcctcagccatggtatggatccctctcttcctcggcgtccttgcttactgcacaggatttgtggcctcctatgagctgactaagccaccctccgtgtccgtgtccccaggacagacagccagcgtcacctgctcgtggggataaattgcgngatagattattgtttcctggtatcaacagaagccaggccagtcccctgtcgtgtcatctancaagacacaagcgccctgaggactccctgagcgtattctcgtcggcctaccaactcgtagggaaaccacncgcctactctacgaccatcgaggcgggatggcgaggcgtaggtaggagtggacggtcttacgttactttacgtcggttacggggaggggttcgggacggaacgacggaccgacgtcggttccgggtccgggttcggggttccgggggaccgggggaaccaacggtccgttacggtcccgttccgtccggtaccgaccggccgacggcccgtccccggtccccgtcggtcccttacgttcccgttcccggttcccccg

SEQ ID NO: 424219 - DNA, 537 bp, Homo sapiens
  misc_feature: GZ8MTXP01EVRXC.51.27.C05.1.454.CMB.2.raw
  modified_base (249)..(249): a, c, t, g, unknown or other
  modified_base (294)..(295): a, c, t, g, unknown or other
  modified_base (298)..(300): a, c, t, g, unknown or other
  modified_base (302)..(303): a, c, t, g, unknown or other
  modified_base (306)..(307): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttattaanttatgtctctacgtaccacaccaccacgacaacacccaactacannatnnntnngtnntcgctcgtacggttacgactcgtctctcgtcgtactaccgacgtaccgaccaaccgaccgtccctaccgtacgacctacgtcgtcgtcggaccgtaccgacggaccggacggacgacggtacgtagtacttattaactacgttacctaccttacgtaactaacttaacgaacgacgaacgaacgtaacgtaacggttacgggttacggtaacgggttaacgggtaacggg

SEQ ID NO: 424220 - DNA, 530 bp, Homo sapiens
  misc_feature: GZ8MTXP01COI06.51.27.C05.1.454.CMB.2.raw
  modified_base (207)..(207): a, c, t, g, unknown or other
  modified_base (221)..(221): a, c, t, g, unknown or other
  modified_base (294)..(294): a, c, t, g, unknown or other
  modified_base (304)..(304): a, c, t, g, unknown or other
  modified_base (354)..(354): a, c, t, g, unknown or other
  modified_base (407)..(407): a, c, t, g, unknown or other
  modified_base (424)..(424): a, c, t, g, unknown or other
  modified_base (428)..(428): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcatcaccatcnctgcactggaaccngcagtgacgttggtgttataattatgtctctggtaccaacaccaccaggcaaacgccccaaatcatgatttangatgtcagtnatcggccctgaggggtttcaatcgcttctcgtggctcaagtccgacaacncggcctcctgaccatctctgggctcgaggccgaggacgaggctgattatacgnacactcagtatacgaanacanacagtagtaggtgtcggacggacggacgaacgcgttacgtacgttcgtacgtcgacgccgacgtccgtccgtcccgtccgtccgttcctccgttccgtcccg

SEQ ID NO: 424221 - DNA, 532 bp, Homo sapiens
  misc_feature: GZ8MTXP01AJ816.51.27.C05.1.454.CMB.2.raw
  modified_base (250)..(250): a, c, t, g, unknown or other
  modified_base (303)..(303): a, c, t, g, unknown or other
  modified_base (366)..(366): a, c, t, g, unknown or other
  modified_base (376)..(376): a, c, t, g, unknown or other
  modified_base (421)..(421): a, c, t, g, unknown or other
  modified_base (427)..(427): a, c, t, g, unknown or other
  modified_base (431)..(431): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctcctggtaccaacaccacccaggcaaacgcccccaaactcatgatttangatgtcagtgactcggccctgagggggtttcaatcgcttctctggctcgaagtccggacaacncggcctcccngaccatctctcgggctccgaggccgaggacgaggctgattatacngcactnatanacaagcagcaactagttggtgtcgggcggtacggaccaagcttcgaccgttcgtaggtcacgcccgaaggcctcgcccctcggcactcgttccgttccccg

SEQ ID NO: 424222 - DNA, 549 bp, Homo sapiens
  misc_feature: GZ8MTXP01CVGM2.51.27.C05.1.454.CMB.2.raw
  modified_base (354)..(354): a, c, t, g, unknown or other
tcagcgatcgtatacacgaccggtgctcgatttagacgcgatcgaagggtttggggactggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatatatgtctctgtacaacacaccagcaaacgcccccaaatcatgatttatgatgtcagtgatcggcctgaggggtttcaatcgccttctctgctccaaagtcccgnaaacacggcctccctgaccatctctggctcgaggccgaggacgaggctgattatactgcactcatatacaagaccagacaaactaagttgggtcgttcggcgggaagggaacccaaggtcgttaggacccgttcgttacggttcgacgaacccgaaacggccttccggcccccttcgggtccttaaccgttcccg

SEQ ID NO: 424223 - DNA, 544 bp, Homo sapiens
  misc_feature: GZ8MTXP01D6UJQ.51.27.C05.1.454.CMB.2.raw
  modified_base (250)..(250): a, c, t, g, unknown or other
  modified_base (299)..(299): a, c, t, g, unknown or other
  modified_base (363)..(363): a, c, t, g, unknown or other
  modified_base (419)..(419): a, c, t, g, unknown or other
  modified_base (455)..(455): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctggtaccaacaccaccaggcaaacgccccaaatcatgatttangatgtcagtgatcggccctgagggggtttcaatcgcttctcctggctccaagtcccggacaacncggcctccctgacccatctctgggctccgaggccgaggacgaggctgattattacngcacctcatatacaagcaagcaaacaagttggggtnttcggggacggacgggaccaaaggcttggacccgttcgtaggtcaacgccccaaggcctcgccccttcggccactccgttcgttccccc

SEQ ID NO: 424224 - DNA, 539 bp, Homo sapiens
  misc_feature: GZ8MTXP01DREO4.51.27.C05.1.454.CMB.2.raw
  modified_base (470)..(470): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggcaaacgcccccaaactcatgtatttatgatgtcagtgatcggcctgagggtttcaatcgtcttctctgctcaaacgtccgcaacacggccctcctgaccatctcgtggcctcgacggccgaggacgaggctgattacgtactcgacacctcaatactaacaagcagactaaactagttgggtgttcggngggaacggacaagcttaggaccgtcgttacggttcacgcccgagcctcgccccttggtccaacttcccg

SEQ ID NO: 424225 - DNA, 532 bp, Homo sapiens
  misc_feature: GZ8MTXP01ESMQB.51.27.C05.1.454.CMB.2.raw
  modified_base (303)..(303): a, c, t, g, unknown or other
  modified_base (313)..(313): a, c, t, g, unknown or other
  modified_base (427)..(427): a, c, t, g, unknown or other
  modified_base (459)..(459): a, c, t, g, unknown or other
  modified_base (525)..(525): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttatattatgtctcctggtaccaacaccaccaggcaaacgcccccaaatcatgatttangatgtcagtnatcggcctgaggggtttcaatcgccttctctggctccaaagtccgcaaacacggccctccctgaccatctcgtgggcctcgagggccgaggacgaggctgattatactgcactnatatacagcagacaatagttgggtgttcgggngggaacggacaagcttacgaccgtacgttacggttcacgcccgaggccctcggcccccttggtccnccgttcc

SEQ ID NO: 424226 - DNA, 572 bp, Homo sapiens
  misc_feature: GZ8MTXP01AVARY.51.27.C05.1.454.CMB.2.raw
  modified_base (461)..(461): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagcccaccctccgtgtccgtgtccccaggacagacagccagcgtcacctgctcgtggggataaattgcgcgatagatatgtttcctggtatcaacagaacgccaggccagtcccctgtcgtggtcatctatcaagacaccagccgccctgagggactcccgtgacgcgtattccctctcggcctaccaactcgtacgggaacacacgcccactctacgaccatcgacggcgggacgcgaggcgtggtggagtggaggctgttactttacgtggtcgagggcgtagggacgacgcgacncgtcgtccggtcggtcggggcgggggtaaccacggcgtcggacccgtccgtcggttccgcggcccgaaggtcccgtccgccccgtccggttcctaaccgttccgttccccg

SEQ ID NO: 424227 - DNA, 559 bp, Homo sapiens
  misc_feature: GZ8MTXP01DZCY4.51.27.C05.1.454.CMB.2.raw
  modified_base (246)..(246): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcnggtatcaacagaagccaggccagtcccctgtcgtggtcatctatcaagaccaaccaagccggccctcgagggactccctgagcgattcctctggctcccaactctagggaacacacgcccactctagaccatcaggcgggacgcgaggcgtggtggagtggaggtctggtacttttacgtgggttcgagggtcggtagggacagccgaacgacgtcggtccggtggttccggggcgggggaaccaaggcgtcggaccgtccgtcggttcgcgcccgaaggcctccgccccgtcggttcctcgttccgttcccg

SEQ ID NO: 424228 - DNA, 575 bp, Homo sapiens
  misc_feature: GZ8MTXP01DYVEM.51.27.C05.1.454.CMB.2.raw
  modified_base (323)..(323): a, c, t, g, unknown or other
  modified_base (367)..(367): a, c, t, g, unknown or other
  modified_base (498)..(498): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccacccaggcaaacgacccccaaatcatgatttatgatgtcagtgatcggccctnagggggtttcaatcgcttctctggctccaagtcccggaacaacnccggcctccctgaccactctcgtcgggcctccgagggccgaggaccgaggctgaattatactgctacctctataataacaagcaagacaaacgtaagtttggggtgttcgggacgggacgggaacaaggcnggtacccgttacgtaggtccacggcccaacgggcctccggtccccctgggtaccttaccgtccttcggttaaccccc

SEQ ID NO: 424229 - DNA, 570 bp, Homo sapiens
  misc_feature: GZ8MTXP01CUJT7.51.27.C05.1.454.CMB.2.raw
  modified_base (230)..(230): a, c, t, g, unknown or other
  modified_base (378)..(378): a, c, t, g, unknown or other
  modified_base (383)..(383): a, c, t, g, unknown or other
  modified_base (408)..(408): a, c, t, g, unknown or other
  modified_base (423)..(423): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctgtaccaacaccaccagcaaacgcccccaaactcatgatttatgatgtcagtgactccggcctggtagggtttcatcgtccttctcgtgcctaccgaacgtcccgcaacgcgccctccngaccntctctggcctcgaggccgaggacgngtctgtattactacngaccactcaagtacaacgaagacacgacaaacgtaggttcggggtgttccggggagggaacggtaccaaaggtccttacggaacccgtcgttacggttcaccggaacccgacggtcctcccggacccccgttcgtccaacgttcccg

SEQ ID NO: 424230 - DNA, 545 bp, Homo sapiens
  misc_feature: GZ8MTXP01CICGR.51.27.C05.1.454.CMB.2.raw
  modified_base (255)..(255): a, c, t, g, unknown or other
  modified_base (309)..(309): a, c, t, g, unknown or other
tcagcgatcgtatacacgaccggtgctcgatttagacgcgatcgaagggtttgggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacngaagccaggccagtcccctgtcgtggtcatctatcaagcaccaagcggcccctnagggatccctgagcgattcctctggctccaactctgggaacacacgccactctgaccatcagcgggacgcaggctggtggatggaggctgtacttttacgtgggtcgaggggcggtgggacagcgacgacgtgtccgtggttcgggcgggggaaccgaaggcgtcggaccgtcccgtcggttccgcgccccgaaggccgtccggccccctcgggttcctaacccgttcgttccccg

SEQ ID NO: 424231 - DNA, 567 bp, Homo sapiens
  misc_feature: GZ8MTXP01D378D.51.27.C05.1.454.CMB.2.raw
  modified_base (437)..(437): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaatgcgcgatagatatgtttcctggtatacaacagaagccaggccacgtcccctgtcgtgtcatctatcaagacaccaagccggccctgagggactcccgtgacgcgtacttcccgtctggcctacccaaactcgtacgggaacacacgcccactctacgaccatcgaggcgggacgcgaggctaggtggatgggagtctgtacttttacgnggtcgagggtcgtgggacagcgacgtacgtcggtccggttcgggtccggggcgggggaacacggcgtacggaccgtccgtcgcgcgcccgaaggcctccggaccccctggttacctccgttcgttccccg

SEQ ID NO: 424232 - DNA, 632 bp, Homo sapiens
  misc_feature: GZ8MTXP01AN2K8.51.27.C05.1.454.CMB.2.raw
  modified_base (303)..(303): a, c, t, g, unknown or other
  modified_base (340)..(340): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctggtaccaacaccacccagcaaacgcccccaaatcatgatttangatgtcagtgatcggcctgagggtttcaatcgcttcncgtggcctccgaaacgtcccggcaacgaccggccctccctgaccatcctcgtcgggcctccgacgggcccgaagggaccggaggtcctaggtaatttacgttaacctgtaccctaaccgttctaaatactaaccaaagccaaggacctaaacgtaaggttcgggggttacgttcgggcgggaacggggaaccaagggtccttacggacccgttaccgttacgggttccgaaccggcccgaaacgggtccctacccggtccccccgttcgggtaacccttaaccgtttccccg

SEQ ID NO: 424233 - DNA, 536 bp, Homo sapiens
  misc_feature: GZ8MTXP01D70TG.51.27.C05.1.454.CMB.2.raw
  modified_base (226)..(226): a, c, t, g, unknown or other
  modified_base (302)..(302): a, c, t, g, unknown or other
  modified_base (365)..(365): a, c, t, g, unknown or other
  modified_base (424)..(424): a, c, t, g, unknown or other
  modified_base (434)..(434): a, c, t, g, unknown or other
  modified_base (442)..(442): a, c, t, g, unknown or other
  modified_base (480)..(480): a, c, t, g, unknown or other
  modified_base (522)..(522): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctcctggtaccaacaccacccaggcaaacgccccaaactcatgatttangatgtcagtgatcggccctgaggggtttcaatcgcttctcctggctccaagtcccggacaacncggcctccctgaccatctcgtgggactccgaggccgaggacgaggtctgtattattacncgactactanatacaganacagacaagtagttggtcgtcggaggacggacaagtcncgtccgttcgtacgcacgccgacgtcctccgccccgtgtccnctccgttccgtccc

SEQ ID NO: 424234 - DNA, 510 bp, Homo sapiens
  misc_feature: GZ8MTXP01AFILX.51.27.C05.1.454.CMB.2.raw
  modified_base (304)..(304): a, c, t, g, unknown or other
  modified_base (323)..(323): a, c, t, g, unknown or other
  modified_base (342)..(342): a, c, t, g, unknown or other
  modified_base (429)..(429): a, c, t, g, unknown or other
  modified_base (433)..(434): a, c, t, g, unknown or other
  modified_base (441)..(441): a, c, t, g, unknown or other
  modified_base (453)..(453): a, c, t, g, unknown or other
  modified_base (465)..(465): a, c, t, g, unknown or other
  modified_base (506)..(506): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaagcccccaaatcatgatttangatgtcagtgatcggcctnagggtttcaatcgcttctntggctccaaaagtccggcaaacacggcctccctgaccatctctgggctccaggccgaggacgaggctgattatactgcactcataanacannagacaanagtggtgtcggnggaaggacagcncgaccgtcgagcacgaaccgagcctccgccccgttcgtccncgtc

SEQ ID NO: 424235 - DNA, 585 bp, Homo sapiens
  misc_feature: GZ8MTXP01CWQAI.51.27.C05.1.454.CMB.2.raw
  modified_base (300)..(300): a, c, t, g, unknown or other
  modified_base (364)..(364): a, c, t, g, unknown or other
  modified_base (430)..(430): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggcaaacgccccaaatcatgatttangatgtcagtgatcggccctgaggggtttcaatcgcttctcctggctcgaagtcccggaacaacnccggccctccctgaccatctctcgggctccgaggccggagacgaggctgtattatactgctacctnaatagtaacaagacagactaaacgtaagttggggtcgttcgggacgggacgggaaccaagtcgttacgacccgttcgtaaacgggtcaaacggccccaaaggggtccctaccggtcccccgtgggtacccttaccgttccgttcccgttcccccg

SEQ ID NO: 424236 - DNA, 541 bp, Homo sapiens
  misc_feature: GZ8MTXP01B7MGM.51.27.C05.1.454.CMB.2.raw
  modified_base (303)..(303): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccaacaccaccagcaaacgcccccaaatcatgatttangatgtcagtgatcggccctgtagggtttcaatcgccttctcgtgcctccgaaacgttcccggcaaacaccggccctccctgaccatctcgtgggctcgaggccgaggacgaggctgattagtactgccactcatactacaagcaagacaaactagttggggtgtcggcgggaaggaccaagcttgaccgtcgttaggccagcccctaaggcctcgccccgttaggtccaacgttcccg

SEQ ID NO: 424237 - DNA, 579 bp, Homo sapiens
  misc_feature: GZ8MTXP01AVZGD.51.27.C05.1.454.CMB.2.raw
  modified_base (417)..(417): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagccggccctcgaggactcctgagcgattcctctggctccaactctagggaacacacgccactctcgaccatcagcgggacgcgaggctaggtggatgaggctgtacttttacgngggtcgagggcgtagggactaggccgaacgacgtcggaccggttcgggttccggggccggggggtaaccaaacggcgtccggacccgttccgtccgggttcgaccggccccgaagggcccgtcccgcccccgttcgggttcctaaccgttccgttaaccccg

SEQ ID NO: 424238 - DNA, 633 bp, Homo sapiens
  misc_feature: GZ8MTXP01ENXLI.51.27.C05.1.454.CMB.2.raw
  modified_base (230)..(230): a, c, t, g, unknown or other
  modified_base (253)..(253): a, c, t, g, unknown or other
  modified_base (301)..(301): a, c, t, g, unknown or other
  modified_base (509)..(509): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataatntgtctctgtacaacaccaccagacaaacgccccaaatcatgtatttangatgtcagtgactcggcctgtagggtttcatcgtccttctcgtggcctacgaaaacgtcccggcaaaccgaccggtccctaccctacgaccattctcgtgggcctcgaggaccggaggacgacgtctagtaattactactcgacctacctactaataacaacaaagcaagtaccaaacgttaaggtttcggggtacggttaccggggngggaaacggggaacccaaaggtcccgttacggtaacccgttaccggttaacggttccgaaccgaaccccggaaggtccccgttacccggtcccccgttcgggttaaccccttccggtttccccg

SEQ ID NO: 424239 - DNA, 549 bp, Homo sapiens
  misc_feature: GZ8MTXP01AKBDX.51.27.C05.1.454.CMB.2.raw
  modified_base (360)..(360): a, c, t, g, unknown or other
  modified_base (428)..(428): a, c, t, g, unknown or other
  modified_base (532)..(532): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaaagacaccaagccggccctcggggactcccgtgagcgattctcctggctccaactctacgggaacncgagcccactctgaccatcgacgcgggacgcgaggctgtggatgagctgtactttacgtgtcggaggnggtagggacgagcgacgacgtcgccggttggtccgggcgggggaccgaacgcgttcggacccgttccgtcggtcgacgcccgacggcctccgccccgtcggccnccgtccttcgttccccc

SEQ ID NO: 424240 - DNA, 552 bp, Homo sapiens
  misc_feature: GZ8MTXP01DTJ6Q.51.27.C05.1.454.CMB.2.raw
  modified_base (226)..(226): a, c, t, g, unknown or other
  modified_base (250)..(250): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattntgtctctggtaccaacaccaccaggcaaacgcccccaaactcatgatttatgatgtcagtgatcggccctgaggggtttcaatcgcttctcctggctcaagtcccggacaacgcgcctccctcgaccatctctcgggcctccgaggccgaggacgaggctgattatactgcactcatatacaagcagacaactaagttggggtgttcgggacggagggaccaagtcgttcggacccgttcgtaggtccaacgcccgaacgggcctaccgcccccgtcggaccttctccgttccgtttccccc

SEQ ID NO: 424241 - DNA, 590 bp, Homo sapiens
  misc_feature: GZ8MTXP01EYSW1.51.27.C05.1.454.CMB.2.raw
  modified_base (297)..(297): a, c, t, g, unknown or other
  modified_base (307)..(307): a, c, t, g, unknown or other
  modified_base (361)..(361): a, c, t, g, unknown or other
  modified_base (405)..(405): a, c, t, g, unknown or other
  modified_base (422)..(422): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccaccaggcaaagcccccaaatcatgatttangatgtcagtnatcggccctgaggggtttcaatcgcttctcctggctcgaagtcccggaacaacncggccctccctgaccatctctcgggctccgagggccgaggacgnggtactgtattattacngcactcaatataacaagcagacaaacgtaagttggggtcgttcgggacgggacgggaaccgaaggtccgttacggacccgttaccgtacgggtccaaccggccccgaaagggtccctccggtaaccccccgttcgggtacccgaccttccgttcccggtttccccccg

SEQ ID NO: 424242 - DNA, 644 bp, Homo sapiens
  misc_feature: GZ8MTXP01D847L.51.27.C05.1.454.CMB.2.raw
  modified_base (226)..(226): a, c, t, g, unknown or other
  modified_base (298)..(298): a, c, t, g, unknown or other
  modified_base (454)..(454): a, c, t, g, unknown or other
  modified_base (464)..(464): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttataattatgtctctgtaccaacaccaccagcaaacgccccaaatcatgtatttangatgtcagtgactcggccctgtagggtttcaacgttcgtcttcctccgtcggtacttaccgaacgtcccggaaccaaacccgccggtccctaccccgtcaccctacttcgtcgtcggtcctcgacggcggaggacgaggtctagtacttagttacncaccacctanaacgttaacaaacgaagaccaagtacctaaacgtaaggtttcggggtcgttcggggacggaacggggaacccaaaggtccgttacggtaacccgttaccgttacggaccgaaccgcccgaacgggtccctccccggtaaccccgttcggtacccaccttccgttaacccgtttccccccc

SEQ ID NO: 424243 - DNA, 592 bp, Homo sapiens
  misc_feature: GZ8MTXP01DUJAQ.51.27.C05.1.454.CMB.2.raw
  modified_base (249)..(249): a, c, t, g, unknown or other
  modified_base (258)..(258): a, c, t, g, unknown or other
  modified_base (437)..(437): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgtttccnggtatcaanagaagccaggccagtcccctgtcgtggtcatctatcaagaccaaccaagccggccctcgagggtacttccgtgagcgtatttcctctaggcctacccaacttccgagggaaccacacgccctactctacgaccatcgacggcgggacgcgaggctggtgatgagtctgtacttttacgngggtacgagggtcgtagggacacgcgacgtacgtcggtcccggtggtccggggcgggggaaccaacggttcgtacggttacccggttccgtcggttaccgcggaccccgaacgggcctccggtcccccgtggttaccctccttcccgtttccccg

SEQ ID NO: 424244 - DNA, 626 bp, Homo sapiens
  misc_feature: GZ8MTXP01BY4BJ.51.27.C05.1.454.CMB.2.raw
  modified_base (252)..(252): a, c, t, g, unknown or other
  modified_base (454)..(454): a, c, t, g, unknown or other
  modified_base (463)..(463): a, c, t, g, unknown or other
  modified_base (477)..(477): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtcccgtgtcccccaggacagacagccagcgtcacctgctcgtggggataaattgcgcgatagatatcgtttccnggtatcaacagaacgccaggcccagtcccctgtcgtggtcatctatcaagaccaaccgaagccggacccctcgacggggtactccccgtgacgtcgtatttccctcgtcggctacccgaactcgtagggaaccacacgacccactctcgaccatcgaggccgggacgcgagggctggtgagtggaggctagtacttttacgnggggtacgngggcggtagggacncggccgacgtacgtcggtccgggtgggttccgggggaccggggggtaacaacggccgtcggaccccggtccggtcgggttaccgccggacccggaacgggtccctcccggtcccccgttcgggttccctaacccgttccggttcccccg

SEQ ID NO: 424245 - DNA, 694 bp, Homo sapiens
  misc_feature: GZ8MTXP01BAI2V.51.27.C05.1.454.CMB.2.raw
  modified_base (254)..(254): a, c, t, g, unknown or other
  modified_base (353)..(353): a, c, t, g, unknown or other
  modified_base (419)..(419): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagcccaccctccgtgtcccgtgtcccccaggacagacagccagccgtcacctgctcgtggggataaattgcgcgatagattatgtttccnggtatcaacagaacgccaggccacgtcccctgtcgtggtcatctatcaagaccaccaacggccgcccctacgagggactcccgtgacgcgtatttcccncgtggccctaccaactcgtacgggaaccacgacgcccactctacgaccatccgaaggccggggacnccgaggtcgtaggtaggtagtggacggtccttagttaaccttttttaccggcggggtacggtacgggggtccggtacgggaaccgacggaccgtaaccgtaccggtccgggtccgggttacgggggtacccggggggacccgggggtaacctacgggttcccggtacccggttacccggtcccggtaccgggttacccgaccgggaccccggtaaccggtccccgtccccggttcccccggtacggttaccccgttcccgtttccccgttccccg

SEQ ID NO: 424246 - DNA, 571 bp, Homo sapiens
  misc_feature: GZ8MTXP01BCZQE.51.27.C05.1.454.CMB.2.raw
  modified_base (226)..(226): a, c, t, g, unknown or other
  modified_base (249)..(249): a, c, t, g, unknown or other
  modified_base (300)..(300): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttatattntgtctctggtaccaacaccacccaggcaaacgccccaactcatgtatttangatgtcagtgactcggccctgtaggggttcatcgcttctctggctcgaagtccgaacaacgcggtccctccctcgaccactctcgtcgggcctcgacggccggaggacgaggctgtaactttatactcgactacctacagtataacgaagcaagaccaacgtaagttgggtacggttcgggacggtacgggacgaaagcgttacggtaccgttccgaggtcacggccaacggcctcggccccttcggtcaccgttccgttcccggttcccc

SEQ ID NO: 424247 - DNA, 539 bp, Homo sapiens
  misc_feature: GZ8MTXP01A60SG.51.27.C05.1.454.CMB.2.raw
  modified_base (226)..(226): a, c, t, g, unknown or other
  modified_base (360)..(360): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctgtacacacaccagcaacgccccaaactcatgatttatgatgtcagtgatccggccctcgtaggggttcaatcgtcttctcctggctccaacgtccggacaaccncggccctccctgaccatcctctcgggcctccgaggccggaggaccgaggtctagtattatactgcctactcaagtatacgaagcagaccaataagttggggtgttcgggagggacggacaagcttgacccgttcgacggtcacgcccaggcctcgccccttcggcacctcttcgtcccc

SEQ ID NO: 424248 - DNA, 547 bp, Homo sapiens
  misc_feature: GZ8MTXP01DJSDL.51.27.C05.1.454.CMB.2.raw
  modified_base (230)..(230): a, c, t, g, unknown or other
  modified_base (286)..(286): a, c, t, g, unknown or other
  modified_base (520)..(520): a, c, t, g, unknown or other
  modified_base (539)..(539): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacgttggtgttataattatgtctctgtacacacaccagcaagccccaancatgatttatgatgtcagtgatcggccctgtagggttcgatcgtccttctctggctccaaagtccgcaacgccggcctcccgtgacctatcctctgggcctccgacggccggaggacgaggctaggattatacgtgccacctcgaataactaacagcaagacaaactaagttgggtacgttcggcgggaacgggacaaggcttacgaccgtcgttaggttcacgcccaaggtcnccgaccccttggtaacccncgttcccg

SEQ ID NO: 424249 - DNA, 543 bp, Homo sapiens
  misc_feature: GZ8MTXP01A8BZ0.51.27.C05.1.454.CMB.2.raw
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggcaaacgcccccaaactcatgatttatgatgtcagtgatcggccctcgtagggggtttcaatcgctttctcctggctccgaacgtcccggacaaccgcggccctccctgaccatctcgtgggcctcgacggccgaggacgaggctagattatactgcacctcatatacaagcagacaacaagttgggtcgttgggcggaggacccaagcttcgaccgttcgtaggtcacgcccgaaggctccgcccctcggtccactcttcgttccccc

SEQ ID NO: 424250 - DNA, 665 bp, Homo sapiens
  misc_feature: GZ8MTXP01CW4TX.51.27.C05.1.454.CMB.2.raw
  modified_base (227)..(227): a, c, t, g, unknown or other
  modified_base (251)..(251): a, c, t, g, unknown or other
  modified_base (365)..(365): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctacctggacagtcgatcaccatctcctgcactggaaccngcagtgacgttggtgttataattntgtctctgtaccaacaccaccaggacaaacgccccaaactcatgatttatgatgtcagtgactcggccctgagggggtttcaatcgcttctcctggctccacgtccgaacaacnccggccctccctagaccatcctctcgggcctccgacggccggacggacggacgggcttagtaactttaacgttactgtacctaacccttactaagttaaactaaccgaaagtaccgaagaacccctaaaacgttaagtttacggggggtacgtttaccggggaacggggtaacgggaaacccgaaacggtcgttaccgggtaacccggttccgtttaaacgggtccaacgggcccgaaacggtccgtacccggtcccccgttacgggtcccttaacctttcccgttaaccgtttcccccc

SEQ ID NO: 424251 - DNA, 563 bp, Homo sapiens
  misc_feature: GZ8MTXP01AKYLI.51.27.C05.1.454.CMB.2.raw
  modified_base (368)..(368): a, c, t, g, unknown or other
  modified_base (376)..(376): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccacccaggacaaacgccccaaactcatgtatttatgatgtcagtgactcggccctgtagggggtttcaatcgcttctcctggctcaagtccggacaacncgcctccngacatctcgtcgggctaccgaggccgagtaccgaggctagattatactgcacttcaatatacagacagacaactaagttgggtgttaccgggaggaacggacccaaagccgttaggacccgttcgtaaacgggccaaggccccagggtcctcggcccccgtcggtcaccttccgttccgttcccccg

SEQ ID NO: 424252 - DNA, 534 bp, Homo sapiens
  misc_feature: GZ8MTXP01EFYH6.51.27.C05.1.454.CMB.2.raw
  modified_base (476)..(476): a, c, t, g, unknown or other
  modified_base (516)..(516): a, c, t, g, unknown or other
  modified_base (529)..(529): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaaactcatgatttatgatgtcagtgatcggcctgtagggtttcaatcgccttctctggctccgaaacgtcccggcaaaccaccgggccctccctgacccatcctctcgggctccgaggccgaggacgaggtctgattactactgcacgtcatatacaagcagcaaacgtagttggtgttcggnggaagggaccaagcttgaccgtcttacgttcagccaggcncgccccttcgtcncgtcc

SEQ ID NO: 424253 - DNA, 546 bp, Homo sapiens
  misc_feature: GZ8MTXP01EMS2Z.51.27.C05.1.454.CMB.2.raw
  modified_base (251)..(251): a, c, t, g, unknown or other
  modified_base (373)..(373): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctcctggtaccaacaccacccaggacaaacgacccccaaactcatgtatttatgatgtcagtgatcggccctgtagggttcaatcgtcttctcctggctccgaagtcccggaaccaacnccggccctccctcgacctatcctcgtcgggcctccgacggccggaggacgaggctagtattatactgcactcatactacaagcagcaacgtaagttgggtgtcggcggaggacaagcgttcgaccgttcgtagtcacgcccaggcctcgcccctggccactccgttcgtcccc

SEQ ID NO: 424254 - DNA, 692 bp, Homo sapiens
  misc_feature: GZ8MTXP01BYCQV.51.27.C05.1.454.CMB.2.raw
  modified_base (227)..(227): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgtatatatgtctctcgtacaacacactacacgacgaaacaccccaaacctacactatattattagatagtcagtagtacgtaccggtccctacgtaggggtttacggtaactcgtccgttccttcgtcggtccgtaccctaacggttaacccggaccgaaccgaaccgggtccccgtccccttaccggacctactccgtccgtacggggtccgacccaaccggggccggaaccgggaaggacggtaccgttagttaacgttaacttaccgcgtacctaacccttagtaaacttaagtaaaccgaacgacgaacgtaaccgtaaagttacgggtttggggtcgggttaccgggacggaacgggaacctacgttcgtacgttacccgttaccgtaggaccgcgacccgtaaggtccctccccgtccccgtcggttctaacccgttccgtcccg

SEQ ID NO: 424255 - DNA, 556 bp, Homo sapiens
  misc_feature: GZ8MTXP01DQK6O.51.27.C05.1.454.CMB.2.raw
  modified_base (230)..(230): a, c, t, g, unknown or other
  modified_base (409)..(409): a, c, t, g, unknown or other
  modified_base (421)..(421): a, c, t, g, unknown or other
  modified_base (465)..(465): a, c, t, g, unknown or other
  modified_base (546)..(546): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataattatgtctctggtaccaacaccaccaggacaaacgcccccaaatcatgatttatgatgtcagtgactcggcctgtagggtttcatcgtcttctctggctccaaagtccgcaacgcggccctcctcgacctatcctcgtggctcgaggccgaggacgngctgattatacngccactacatatacagcagacaaactagttgggtcgttacgggngggaacggacaaggcgttacggacccgttccgttaaggttccacgtcccgaaaggtcctcccggccccgttcgggtaaccncgtttccccg

SEQ ID NO: 424256 - DNA, 792 bp, Homo sapiens
  misc_feature: GZ8MTXP01D2WMX.51.27.C05.1.454.CMB.2.raw
tcagcgatcgtataccacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataatatgtctctgtacaacaccacccaggacaaacgcccccaaatcatgatttatgatgtcagtgactcggccctcgtacgggggtttacaaacgttccgtcctttcctcgttcgggtcctacccgaaaacggttccccgggaaccaaacccgtaacccgggccccttacccccgttacggaaccccacggtttccctccgtcgggtcccttacccgaacggggcccggaaggggaacccggaagggtccttaggtaatttaacgttaactcgtaccctacccgttaacaacttaaacttaacccaaaggaccctaacggaccctaaaacgtaaaggttttcggggggttaacggtttaccgggggacccgggggtaaacggggtaaacccccgttaaaggggccccgttaacgggtaaaccccggtttacccgggttaaacgggggttcccgaaaccgggtaacccccgaaaacggggtccccgttaaccccggtcccccccggtttaccggggtccccttaaccccgggttttaacccccg

SEQ ID NO: 424257 - DNA, 640 bp, Homo sapiens
  misc_feature: GZ8MTXP01AT2ED.51.27.C05.1.454.CMB.2.raw
  modified_base (210)..(210): a, c, t, g, unknown or other
tcagcgatcgtatacacgaccggtgctcgatttagacgcgatcgaagggtttggggggggtctcaggaggcagcgctctcggggacgtctccaccatggcctgggctctgctattcctcaccctcctcactcagggcacagggtcctgggcccagtctgccctgactcagcctgcctccgtgtctgggtctcctggacagtcgatcaccntctcctgcactggaaccagcagtgacgttggtagttataattatgtctctgtaccaacaccaccaggacaaacgccccaaatcatgtatttatgatgtcagtgactccggcccttcggtagggggtttacaattcgtctttcgtcctcggcctccgaaacggtcccggaacaaaccgcccggtccctcccgtacgaccctagtcctcgtcgggcctccgacgggccgaagggacgaggtctgtaacttattacgcgctacctcaagtactaacgaacgacgaacgtaccaaagttaagtttcgggggtacggttcggggacgggaacgggacccgtaaaggtccgttacggtcccgttacgtaacggggtaccacggcccgaacggtccctcccgcccccggtcggtcacccttccgttccgttcccccc

SEQ ID NO: 424258 - DNA, 633 bp, Homo sapiens
  misc_feature: GZ8MTXP01BURDB.51.27.C05.1.454.CMB.2.raw
  modified_base (375)..(375): a, c, t, g, unknown or other
  modified_base (403)..(403): a, c, t, g, unknown or other
  modified_base (427)..(427): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatattgtttcctggtatcaacagaagccaggccacgtcccctgtcgtggtcatctatacaagacaccaagccgcctcgaggctccctgacgcgtacttcctcgtggcctaccactcgagggaacacacgcccactcncgaccatcgagcgggacgcgaggctggngatggacgtctacgtacttttcgngggtacgacggggtcggtacggggacacgggaccgacgtaccgtcggtcccggggtttcgggttcccggggggccggggggaaacccaacggggttcccgttaccgggaccccggttcccggtccgggttacccgaccggttaccccggaacggtcccgtaacccggtccccccgtcgggttccctaaccgttcccgtttcccccg

SEQ ID NO: 424259 - DNA, 525 bp, Homo sapiens
  misc_feature: GZ8MTXP01ALXRI.51.27.C05.1.454.CMB.2.raw
  modified_base (265)..(265): a, c, t, g, unknown or other
  modified_base (427)..(427): a, c, t, g, unknown or other
  modified_base (447)..(447): a, c, t, g, unknown or other
  modified_base (459)..(459): a, c, t, g, unknown or other
  modified_base (465)..(465): a, c, t, g, unknown or other
  modified_base (520)..(520): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttgtgtatattatgtctctgtaccaanaccaccaggcaaagcccccaaatcatgatttatgatgtcagtgatcggcctgaggggtttcaatcgccttctctggcctccgaaaagtcccggcaaacaccgggccctccctgaccagtcctctgggcctccgagggccgaggaccgaggctgattattacngccactcatatacaagcagnaaactagtgggntcgggnggaagggaccaaggcttgaccgtcaggttcagtcccaggcctcgccccttggtcnctccg

SEQ ID NO: 424260 - DNA, 538 bp, Homo sapiens
  misc_feature: GZ8MTXP01EHM5A.51.27.C05.1.454.CMB.2.raw
  modified_base (251)..(251): a, c, t, g, unknown or other
  modified_base (366)..(366): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctgtaccaacaccacccaggcaaacgcccccaaactcatgatttatgatgtcagtgatcggccctgtaggggtttcaatcgcttctctggctccaagtcccggaacaacnccggcctccctgacctatctcgtcgggctccgaggccgaggacgaggctgtattatactgcactcatatacaagcagacaactaagttgggtgttcgggacggaggaaccaagcttgaccgttcgtaggtcacgcccaaggcctcgccccgtcggcactccgttcgttcccc

SEQ ID NO: 424261 - DNA, 586 bp, Homo sapiens
  misc_feature: GZ8MTXP01DNH0J.51.27.C05.1.454.CMB.2.raw
  modified_base (227)..(227): a, c, t, g, unknown or other
  modified_base (251)..(251): a, c, t, g, unknown or other
  modified_base (302)..(302): a, c, t, g, unknown or other
  modified_base (362)..(362): a, c, t, g, unknown or other
  modified_base (371)..(371): a, c, t, g, unknown or other
  modified_base (376)..(376): a, c, t, g, unknown or other
  modified_base (415)..(415): a, c, t, g, unknown or other
  modified_base (429)..(429): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttataattntgtctctggtaccaacaccaccaggcaaacgcccccaaactcatgatttangatgtcagtgatcgccctgaggggtttcaatcgcttctctggctcaagtccggaacaacncggcctccngaccntctctgggctcgaggccgaggacgaggctgtattatacngcactcagtactanaagcagactaacgtaagttggggtgttcgggacgggaacgggtaaccgaaaggtcgttacggtacccggttcgttaaacgggtccgaacggccccgaaagggtcccttcccgcccccggttcgggaccttacccttccggttcccgtttcccccccg

SEQ ID NO: 424262 - DNA, 591 bp, Homo sapiens
  misc_feature: GZ8MTXP01BYWH0.51.27.C05.1.454.CMB.2.raw
  modified_base (299)..(299): a, c, t, g, unknown or other
  modified_base (436)..(436): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttataattatgtctctgtaccaacaccaccaggacaaacgccccaaatcatgatttangatgtcagtgactcggccctgtaggggtttcatcgtcttctccgtggctaccgaacgtcccggaacaaaccgccggtccctccctcgacccatctcgtcgggcctccgagggccgaggacgaggctagtattatacncgaccacctacaagtaactaacgaagcaagacaaacgtaagttggggtcgttacggggcggaacggacaagcgttacgtaccgttcgtaacggtcacggcccgaacggtccctaccgccccgttcggtccttaccgttccgttcccgttcccccg

SEQ ID NO: 424263 - DNA, 616 bp, Homo sapiens
  misc_feature: GZ8MTXP01BP2IB.51.27.C05.1.454.CMB.2.raw
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaacgcccccaaactcatgatttatgatgtcagtgactccggcctcgtaggggtttcaattcgccttctcgtggcctaccgaaacgtcccggcaaaccgaccggccctcccctgacccatcctcgtgggcctccgacgggccgaggaccgaggtcgtagattacgtactcgccaaccgttcattaactaacaagctacgactaaacgtaaggtttcggggtcggtttacgggcggggaacgggaaccttaaaggccttcggaacccgttccgttacgggttcgaccgccccgaacgggccctccggccccccgttcggtccttaacccgttcccg

SEQ ID NO: 424264 - DNA, 539 bp, Homo sapiens
  misc_feature: GZ8MTXP01DWXDS.51.27.C05.1.454.CMB.2.raw
  modified_base (231)..(231): a, c, t, g, unknown or other
  modified_base (245)..(245): a, c, t, g, unknown or other
  modified_base (287)..(287): a, c, t, g, unknown or other
  modified_base (384)..(384): a, c, t, g, unknown or other
  modified_base (395)..(395): a, c, t, g, unknown or other
  modified_base (406)..(406): a, c, t, g, unknown or other
  modified_base (410)..(410): a, c, t, g, unknown or other
  modified_base (412)..(412): a, c, t, g, unknown or other
  modified_base (426)..(426): a, c, t, g, unknown or other
  modified_base (432)..(432): a, c, t, g, unknown or other
  modified_base (479)..(479): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccacctccgtgtccgtgtccccaggacagacagccagcgtcacctgctcgtagggataattgcgngatagatatgttcngtatcaacagagccaggcctacgtccctgtcgtgtcatctancaagcaaccaagccggccctgacggactcccgtgagtcgattccctcgtggcctacccaaacttcgacgggaacacacgcccctaatccacgaccancgaagcggacncgtagcgtggngagngngtcgtagtacttgnggtcgnggcgaggacacgcgacgcgtcggtccggtcgggtcgggacgggaacngcgtcgccgtcgtcgccgcgccgaacgcccgtccgcccgtcgttcctccgttccgtcccg

SEQ ID NO: 424265 - DNA, 543 bp, Homo sapiens
  misc_feature: GZ8MTXP01D9K8E.51.27.C05.1.454.CMB.2.raw
  modified_base (303)..(303): a, c, t, g, unknown or other
  modified_base (469)..(469): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataatatgtctctggtaccaacaccaccaggcaaacgcccccaaatcatgatttangatgtcagtgatcggcctgaggggtttcaatcgccttctctggcctccaaagtcccggcaaacaccggccctcccgtgacccatctctagggctcgaggccgaggacgaggctgattatactgcactcataatacaaagcagactaaacaattggggtagttcggnggaagggaaccttaaggcttcgaccgtccagggttccagccccaagggctccgccccttcggtccaacgttccg

SEQ ID NO: 424266 - DNA, 624 bp, Homo sapiens
  misc_feature: GZ8MTXP01DYO27.51.27.C05.1.454.CMB.2.raw
  modified_base (446)..(446): a, c, t, g, unknown or other
  modified_base (465)..(465): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctgtaccaacaccaccaggcaaacgcccccaaatcatgatttatgatgtcagtgatcggccctgtagggtttcaatcgtccttctctcggcctaccgaaaacgtcccgcaaacaccggccctccctgaccagtcctcgtcgggctccgaggccgaagggaccgaggctagacttatactgcaacctnaattactaacaacgcgaanacaaacgtagttacggggtggttccgggaggggaaacgggaacccaaaggtccgttacggaaacccggttcccgttaaaggggttcccaaccggaaccccgaaaggggtcccttcccgggccccccccgttgggtaaccccgttaacccgtttccccgg

SEQ ID NO: 424267 - DNA, 702 bp, Homo sapiens
  misc_feature: GZ8MTXP01CURNO.51.27.C05.1.454.CMB.2.raw
  modified_base (230)..(230): a, c, t, g, unknown or other
  modified_base (255)..(255): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacgttggtgttataattntgtctctgtaccaacaccaccagacaaacgccccaaatcatgtatttatgatgtcagtgactccggcctgtacgggtttacaacttcgtccttccgtcgtcggtcctacccgaaaacggtcccggaactaaaccgacccgggtcccttacccgtacgaaccctacgttccgtccgtcgggccctaccggacgggaccccgaaggggacgtacgggtacctaggttaactttaacgttactacgaccctaaaccgttctaaataactaacgaacgaccgaagtacctaaaacgttaacgggtttggggttacggttaccggggacgggaaacgggaacccgaaacggtcgttaccggtaaacccgttccggttaacggccgaaccggaacccgtaacgggtcccttccccgggtcccccgttacggtaacccttcccgtttaaccccg

SEQ ID NO: 424268 - DNA, 777 bp, Homo sapiens
  misc_feature: GZ8MTXP01CSISB.51.27.C05.1.454.CMB.2.raw
  modified_base (230)..(230): a, c, t, g, unknown or other
  modified_base (302)..(302): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctggtaccaacaccaccagcaaacgcccccaaatcatgatttangatgtcagtgatccggccctacgtacgggggtttcaagttcgtcctttcgtctggcctacccgaaacggttcccggccaaaccgacccgggtacccttccccgtacgaacccctactcccgttccgtggggtcccttcccgacggggcccggaagggaccgggtacgggtccttagggtaactttaaacgtttaaccgtggaacccttaacccgggttacctaaagtttaactaaacccgaaacgacgaaaccggacttaaaaaacccggtaaaggtttcgggggtacggtttcccgggggaaccggggaagggggtaaaccccaaggggtacccgttaaccgggtaaaccccgggttccgttaaacccgggggtttccgaacccggtaacccccgggtaaacggtcccccggtttacccgggtaccccccccccggttcggggttaaccccttaacccccggtttttcccccgg

SEQ ID NO: 424269 - DNA, 690 bp, Homo sapiens
  misc_feature: GZ8MTXP01DZVP1.51.27.C05.1.454.CMB.2.raw
  modified_base (201)..(201): a, c, t, g, unknown or other
  modified_base (297)..(297): a, c, t, g, unknown or other
  modified_base (306)..(306): a, c, t, g, unknown or other
  modified_base (467)..(467): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatcctcctgcactggaaccagcagtgacgttggtgttataattatgtctctagtaccaacaccaccaggacaaacgcccccaaatnatgatttangatgtcagtgactcggccctggtacggggtttcaattccgtcttctcgtggtcctaccgaaacgtcccggaacaaaccgacccggtccctcccgtacgaccctagttcctccgtgggccctccgacggccggaaggacggaggtctagtacttacttacgngtaccctaaccgtactaattaacaacgaagaccgaacgtacgtaaaaccggttaaggttcgggggttacggtttaccgggggaccggggaaacggggtacccgaaacggtcccgttaccgggtacccgttccgggttaaacgggttaccgaacccggaaccccgtaaacgggtcccgttccccggcccccggttccgggtccccttaacccgttttccccccg

SEQ ID NO: 424270 - DNA, 576 bp, Homo sapiens
  misc_feature: GZ8MTXP01DRBJT.51.27.C05.1.454.CMB.2.raw
  modified_base (300)..(300): a, c, t, g, unknown or other
  modified_base (364)..(364): a, c, t, g, unknown or other
  modified_base (378)..(378): a, c, t, g, unknown or other
  modified_base (418)..(418): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggacaaacgccccaaatcatgatttangatgtcagtgatccggccctgagggggtttcaattcgcttctctggctccaagtccggacaacncggcctcctgaccntctcgtgggctccgaggccgaggacgaggctgattatacngctactcatataacagcaagcaaacgtaagttgggtcgttcgggacggtacgggaaccaaagtcgttacggacccgttcgtaagggtccaacggttcccgaaagggtccctccgccccccgttcgggtaccttaccgttcccgttccgtttccccccg

SEQ ID NO: 424271 - DNA, 703 bp, Homo sapiens
  misc_feature: GZ8MTXP01BXV29.51.27.C05.1.454.CMB.2.raw
  modified_base (319)..(319): a, c, t, g, unknown or other
  modified_base (447)..(447): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggtatttgtcggcctcctatgagctgactcacgcccaccctccgtgtccgtcgtccccaggacagacacgccagcgtcaccgtgctcgtaggggaataagttgcgacgtatagtattagttcgtttaccaggtactacgaacgaggaacgccacggcctacgtccctgtcgtgtctatactanacaagaccacgacgccgcctcgacggctccgtgacgcgtacttcccgtacgtcggtacctacccgtaacgtaccggtacggaaccacgaccgtccctactcgtacgacacgtcgacgggaccgggacncggaggtcgtagggagtacgtcgggtacggttacttacggtttaaccttttacgggcggggtacggtacggggtccggtaacggaccgacggtcccgacgtacgggtccgggttacccgggttacgggggtacccggggaccggggtaacacggttcccgtacggttaccccggtccgtccgggaccgccggttaccccgtaagggtcccctccccggttccccgtcgttacccgtccgtttcccggtttcccccg

SEQ ID NO: 424272 - DNA, 606 bp, Homo sapiens
  misc_feature: GZ8MTXP01C6G6V.51.27.C05.1.454.CMB.2.raw
  modified_base (543)..(543): a, c, t, g, unknown or other
  modified_base (598)..(598): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttatattatgtctctgtaccaacaccaccagacaaacgcccccaaatcatgtatttatgatgtcagtgacgtccggccctgtaggggtttcaattccgccttctcgtggcctcccgaaaacgttcccggaactaaaccgacccgggtcccttacccgtcgaccctatcccgtcgttcggggcctccgagggccggaagggacgagggtctagtattacttacgcacctactctaatactaacaagcagacaaacgtaagttggggtagttccgggacgggaacgggaaccaaggtcncggtacccgtgttacggttcgacgcccaagggcctccgtccccgttacggtcccncgttcccg

SEQ ID NO: 424273 - DNA, 690 bp, Homo sapiens
  misc_feature: GZ8MTXP01DOUOO.51.27.C05.1.454.CMB.2.raw
  modified_base (228)..(228): a, c, t, g, unknown or other
  modified_base (254)..(254): a, c, t, g, unknown or other
  modified_base (284)..(284): a, c, t, g, unknown or other
  modified_base (303)..(303): a, c, t, g, unknown or other
tcagcgatcgtatacacgaccggtgctcgatttagacgcgatcgaaggggtttggggggggtctcaggaggcaacgctctcgggacgtctccaccatggcctgggctctgctattcctcaccctcctcactcagggcacagggtcctgggcccagtctgccctgactcagcctgcctccgtgtctggtctccgtggacagtcgatcaccatctcctgcactggaaccngcagtgacgttggtagttaataattntgtctctgtacaacaccaccaggacaaacnccccaaatcatgtatttangatgcagtgatccggcctcgtagggtttacgaatcgtcttctctcggtcctacgacgtccgacaaaccaccggtccctaccctgacctactcctcgtcgggtcctaccgaggccggaagggacgacgtctagtaactttacgttactcgacctaccttataactaacggtaacaacggacaacggaactaaaaccgtaggtttaggggtacggttacggggacgggaacgggtacccgaaaaggtccgttaccgggttacccgtaccggttacggtaccgtaaccgggttaccccgaaagggttccccgtaaccccgggtacccccccgttccgggttacccgtaccctttccgtttaacccccggtttccccccgttaaccccccg

SEQ ID NO: 424274 - DNA, 606 bp, Homo sapiens
  misc_feature: GZ8MTXP01A7M1G.51.27.C05.1.454.CMB.2.raw
  modified_base (303)..(303): a, c, t, g, unknown or other
  modified_base (438)..(438): a, c, t, g, unknown or other
  modified_base (446)..(446): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctggtaccaacaccaccaggcaaacgcccccaaatcatgatttangatgtcagtgatcggcctgaggggtttcaatcgtccttctcgtggctccgaaaagtcccggcaaaccgaccgggtccctacccgtgacccatcctcgtgggcctaccgaggccgaggacgaggctgattactacngccacgtnattacacgaagcagacaaacgtagttggggtacgttcgggcgggaacgggtaacccaggtcccgttacggaccccggttcgttaacgggttcccacgggaaccccgtaaggggtccccttaccggcccccccggttggtaaccccttaaccgtttccccg

SEQ ID NO: 424275 - DNA, 598 bp, Homo sapiens
  misc_feature: GZ8MTXP01EA97U.51.27.C05.1.454.CMB.2.raw
  modified_base (370)..(370): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataattatgtctctggtaccaacaccacccaggacaaacgcccccaaatcatgatttatgatgtcagtgactcggcctcgtaggggtttcaatcgccttctctggctcaaagtccgcaaacncggccctcctgaccatcctcgtgggctccgacggccgaggacggaggtctaggatttaactactcgacctacctactaataacttacaaacgcaagacgtaaacgtaagttggggttagttccgggcgggaaacgggtaccgaaaggtcgttacgacccgttacgttacggttccgaacgcccgtaaggcccttccggccccgttcgggtccttaaccggtttccccg

SEQ ID NO: 424276 - DNA, 576 bp, Homo sapiens
  misc_feature: GZ8MTXP01CBOYM.51.27.C05.1.454.CMB.2.raw
  modified_base (226)..(226): a, c, t, g, unknown or other
  modified_base (250)..(250): a, c, t, g, unknown or other
  modified_base (252)..(252): a, c, t, g, unknown or other
  modified_base (448)..(448): a, c, t, g, unknown or other
  modified_base (555)..(555): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataattntntctctgtaccacaccaccagacaaacgccccaaatcatgtatttatgatgtcagtgactcggcctgtagggttcaatcgtcttctccgtgctaccaacgtcccggaacaaccgccggccctccctacgaccctactcctcgtcgggccctaccgacggaccgagggacgagggtctagtacttatactcgcactanaataactaacaagcaagacaaacgttaagttgggtcgtcgggacggacggaccaagcgttagacccgttcgtacgtcaccgcacggtcctccgtccccgtcggtacnccgttcgttcccgttcccccg

SEQ ID NO: 424277 - DNA, 550 bp, Homo sapiens
  misc_feature: GZ8MTXP01CC1YI.51.27.C05.1.454.CMB.2.raw
  modified_base (428)..(428): a, c, t, g, unknown or other
  modified_base (438)..(438): a, c, t, g, unknown or other
  modified_base (542)..(542): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataatatgtctctgtaccacaccaccagcaaacgcccccaaatcatgtatttatgatgtcagtgatcggcctgtagggtttcaatcgccttctcgtggcctccgaaacgttcccggcaacaccgggccctccctgacccatctcgtgggcctcgagggccgaggacgaggctgattatacngcactcatanacagcagacaaactagttggggtgttcgggacggtaagggaacaggccttaggacccgtcgttagggttcacggtcccgaaggtcctccgcccccgttggtccncgttcccg

SEQ ID NO: 424278 - DNA, 700 bp, Homo sapiens
  misc_feature: GZ8MTXP01A1F3Y.51.27.C05.1.454.CMB.2.raw
  modified_base (227)..(227): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgtacggttggtagttataattatcgtctccgtggtaccaacaccacccaggacaaacgacccccaaactcatgtatttatgatgtcagtgacgtccggccctcggtaggggtttcaatcgtcttctccgtggctaccgaaacgtcccggaacaaaccgcccggccctccccgtacgaccctactccgtcgtcgggtcctaccgacgggccggagggacgaggacgtagtaactttactacgtcgacctacctacaagttaactaacgaaacgacgtaaacgaacctaaaacgttaaaggtttcgggggttacgggttacccgggggaccggggtaaccggggaaacccgtaacggtccgttacgggtaccccgttaccggtacgggtaccgaaccggcccgttaacgggtccccgtcccgtccccccggtacggtcccttaccgttcccgtttcccggttcccccccg

SEQ ID NO: 424279 - DNA, 682 bp, Homo sapiens
  misc_feature: GZ8MTXP01BA9TV.51.27.C05.1.454.CMB.2.raw
  modified_base (301)..(301): a, c, t, g, unknown or other
  modified_base (477)..(477): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgtacgttggtgttataattatgtctctgtaccaacaccaccagacaacgccccaatcatagatttangtatcgtcagtgacgtccgccgtacgtagggttacagtccgtccttctcgtgcctaccgaaacggtcccgcaaaccgcccggtaccctcccgtacgacctacttccgtcgtcgggtcctaccggagggacccggaaggggacggacggttactaggttaactttaacgttaccgtntaccctacgttaactaattaaccaacgaaaggaccaaacgtaccgtaaaacggtttacggtttgggggttaacgttccgggggaacgggggaaacggtacccgaaagggtcccgttacggtacccgttaacggttacggcccgaccggaacccgtaaccggtccgtaccccggtccccgttcgggttaacccttccgtttccccg

SEQ ID NO: 424280 - DNA, 665 bp, Homo sapiens
  misc_feature: GZ8MTXP01CJRVJ.51.27.C05.1.454.CMB.2.raw
  modified_base (229)..(229): a, c, t, g, unknown or other
  modified_base (252)..(252): a, c, t, g, unknown or other
  modified_base (254)..(254): a, c, t, g, unknown or other
  modified_base (266)..(266): a, c, t, g, unknown or other
  modified_base (297)..(297): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtcgtggtctccgtggacagtcgatcaccatctcctgcactggaacngcagtgtagttggagttataatntntctctgacaacncaccagtacaagccccaaatcatcgatttangatgtactaggtcgtagttcccggaccgtcggtaggggttacaaacgtcgtccctttcgctcggtccttaccgaaaacggttcccggaacaaacccgtacgggtcccctacccgtacgacccgtatcctacgtccggcgtaccgacggacccggaaggacgacgggtctagtacttaagtctctaccgtaccgtactaacttaacaacgaacgaccaacgtaccgtaaacgtaacggttgggtaacggttccgggacgggaacggtaacgaaacgggtccgttacggtaaccggtaccgttacggttaacgccggtaaccgaacgtcccgtacccgtccccggttcggtaaccccttcgtttcccccg

SEQ ID NO: 424281 - DNA, 583 bp, Homo sapiens
  misc_feature: GZ8MTXP01AN2ZM.51.27.C05.1.454.CMB.2.raw
  modified_base (228)..(228): a, c, t, g, unknown or other
  modified_base (252)..(252): a, c, t, g, unknown or other
  modified_base (364)..(364): a, c, t, g, unknown or other
  modified_base (374)..(374): a, c, t, g, unknown or other
  modified_base (379)..(379): a, c, t, g, unknown or other
  modified_base (383)..(383): a, c, t, g, unknown or other
  modified_base (387)..(387): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcacgtaggaaccngcagtgacgttggtgttataattntgtctctgacacaccaccagacaaacgccccaaactcatgatttatgtatgtcagtgactccggccctgtaggggtttcaagtcgtcttctctggctccgagtccgacaacnccgcctcccngaccntctntcgnctcgacggcgaggcgagtctagtattactacgtacgactacctctaataactacaaacgcaacgtaccaaagttaacggttggggtacgggttccgggacgggcgggaaacctaaggttcgtaccgttaccggtaccgtaaggttccgacgacccgaaggtccctcccggcccctagacttccgaaccgtttcccg

SEQ ID NO: 424282 - DNA, 678 bp, Homo sapiens
  misc_feature: GZ8MTXP01AXX5E.51.27.C05.1.454.CMB.2.raw
  modified_base (230)..(230): a, c, t, g, unknown or other
  modified_base (305)..(305): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcacgtggaaccngcagtgacgttggtgttataattatgtctctgtaccaacaccaccaggacaaacgacccccaaatcatgatttangtatgtcagtgatccggcctgtagggttcaatcgtccttctctcggcctaccgaaacgtcccggaacaaccgacccgggtccctccctcgaaccctatccgtacgtcggggcctaccggaggcccggaagggaccgagtcttagtaacttacttacgtcacctaaccgtactaattaacgaaacaaggaccaaacgaccgtaaaacgttaacgggtttcgggggttaccggttacgggggcggggtaaacggggaacccttaaacgggtccgttaccggtaaccccggttaccgttaacggggttccaaacccgggccccaacgggtcctcccccggtacccccgttcggtaacccttccccgttttccccgg

SEQ ID NO: 424283 - DNA, 826 bp, Homo sapiens
  misc_feature: GZ8MTXP01BSYOM.51.27.C05.1.454.CMB.2.raw
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagcccaccctccgtgtcccgtcgtccccaggacagacagccagcgtcacctgctcgtaggggattaaagttgcgcgaatagtattacgttcgtttcctaggtactacaaacgagaacgcccgacggcctacgtcccctggtcgtggtctatctatacaaacgaccaaccgaaacggcccggtaccctacgacgggtacctcccgtaggacgcgtactttccccgtcgtcggccctaccaacgtccgtacgggaaccacgacgccctactccgtacgacctacgtccgacgggaccgggaccgacggacggtcgttaggtagggtacgttagggaacggttccttaggtttaaccgtttttaccggtggggttacggtaacgggggtcgggttacggggaaccgtccggggaccgtaaaccggtaccggttccggggtcccgggggtttacgggggttaccccggggggtaacccggggggggaaacccctaacgggggttccccggttacccggggttaacccccggtttacccggggttcccggggttaaccccggcccgggttaaccccccgggtaacgggtcccccggttcccccgggttaccccccccgggtttgggttcccccttaaccccggttttccccgttttaacccccccgg

SEQ ID NO: 424284 - DNA, 642 bp, Homo sapiens
  misc_feature: GZ8MTXP01BS579.51.27.C05.1.454.CMB.2.raw
  modified_base (230)..(230): a, c, t, g, unknown or other
  modified_base (301)..(301): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacaccaccagacaacgccccaatcatgtatttangatgtcagtgactcggcctgtagggtttcagtcgtccttctcgtcggcctaccgaaacggtcccgaacaaaccgacccggcccttaccccgtagaacccctagtccctcgttcgggcctccgacgggaccgaagggaccgagggtcttagtaatttacgtactcgaccctaaccgtataacttaacaaaccgtaagccaacgactaaacgttaaggtttcggggtacgttaccggggacggaacgggaaccttaaggccgttacggtacccgtaccgttagggaccaccggaacccgacggtccctcccggtccccgttcggttccttaaccgtttccccg

SEQ ID NO: 424285 - DNA, 568 bp, Homo sapiens
  misc_feature: GZ8MTXP01CLG4W.51.27.C05.1.454.CMB.2.raw
  modified_base (303)..(303): a, c, t, g, unknown or other
  modified_base (339)..(339): a, c, t, g, unknown or other
  modified_base (354)..(354): a, c, t, g, unknown or other
  modified_base (369)..(369): a, c, t, g, unknown or other
  modified_base (373)..(373): a, c, t, g, unknown or other
  modified_base (376)..(376): a, c, t, g, unknown or other
  modified_base (402)..(402): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccacccaggcaaacgcccccaaatcatgatttangatgtcagtgactcggcctgagggttcatcgcttcnctgctcaaagtccgnaacgaccgcctccgngacntcnctggctcgacggccgaggacgacggntagattattactgcctaccgtcaattactaacaacgcagacaaacgtaagttcgggtacggttcgggcgggaacgggaaccaaaggccgttagtaacccggtcttaacgggttcaccggcccgaaacggcccttccggcccccgttcggtccttaaccgtttcccg

SEQ ID NO: 424286 - DNA, 704 bp, Homo sapiens
  misc_feature: GZ8MTXP01AIK7V.51.27.C05.1.454.CMB.2.raw
tcagcgatcgtatacacgaccggtgctcgatttagacgcgatcgaagggtttgggggggcctcaggaagcagcatcggaggtgcctcagccatggtatggatccctctcttcctcggcgtccttgcttactgcacaggatttgtggcctcctatgagctgactaagccaccctccgtgtccgtgtccccaggacagacagccagcgtcacctgctcgtggggataaattgcgcgatagatattgtttcctggtatcaacagaagccaggccagtcccctgtcgtggtcatctatcaagacaccaagccggccctcgagggactccctggacgcgattcctcgtcggcctaccaactccgtaggggaaaaccacgaacgacccaactctacgacctatacgaagggccgggagtgacgacgggtcgttgggtagggtagtagggacggtacttacgttaaccttttacgtcggtacggggtaacggggtcggggtacgggaacgacggacccgaacgtccggtcgggtcccggtttcgggggtacccggggggaccgggggacccgtaaacgggtcccggttccgggtaccccggttccggttccggggtacccaccgggaccccggaaccgggtccccgtccccgggtcccccggttcccgggtaccccttccggtttccccgttccccgggtttccccccccg

SEQ ID NO: 424287 - DNA, 730 bp, Homo sapiens
  misc_feature: GZ8MTXP01CZ367.51.27.C05.1.454.CMB.2.raw
  modified_base (201)..(201): a, c, t, g, unknown or other
  modified_base (230)..(230): a, c, t, g, unknown or other
  modified_base (258)..(258): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcagtgtacgttggtagttataattatntctctgtaccaacaccaccagacaaacgcccccaaatcatgatttatgatgtacagtgatccggcccgtgtacgggtttacaatcgtccttctcgtcggtacctacccgaaaaacgggttccccggaacaaacccgacccgggtacccctttaccccccgagtaacccctactccttccgtcggggtccctacccggacgggaccccggaaggggaacccgtagggtaccgttaggtaacttacttaccgtacgtccctaaccgttctaaacgttaaactaacccgaaaggacctaaacgacccgtaaaacgtaaaggtttgggggttacggttccggggaacgggtaacgggggaaccccaaaggttccgttaccggtaacccgtacggtttacgggttaccaccgggtaacccgaaaccgggtcccgtccccggtacccccgttacgggtcccttaacccgtttccccgg

SEQ ID NO: 424288 - DNA, 623 bp, Homo sapiens
  misc_feature: GZ8MTXP01ETHWX.51.27.C05.1.454.CMB.2.raw
  modified_base (254)..(254): a, c, t, g, unknown or other
  modified_base (302)..(302): a, c, t, g, unknown or other
  modified_base (443)..(443): a, c, t, g, unknown or other
  modified_base (452)..(452): a, c, t, g, unknown or other
tcagcgatcgtatacacgaccggtgctcgatttagacgcgatcgaaggggtttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataattntgtctctgtaccaacaccaccagacaaacgccccaaatcatgatttangatgcagtgactcggccctgtaggggtttacaatcgtcttctctggctacgagtcccgaacaacgccggccctaccgtcgaacctcttcgtcgtcgggcctaccggaggaccggaggacgaggtacgtagtattacttacncactactanaataacgtaacgaagacaacgactaaacgtaggtttacggggtcggtacgggacggaacggaacgtaacgtcgttacggtaccgttacggtaacggtaccgaccggacccgttacggtcccgttcccggtccccggttcgtacccgttaccgttcccgtttcccgttcccc

SEQ ID NO: 424289 - DNA, 590 bp, Homo sapiens
  misc_feature: GZ8MTXP01DP0O6.51.27.C05.1.454.CMB.2.raw
  modified_base (227)..(227): a, c, t, g, unknown or other
  modified_base (251)..(251): a, c, t, g, unknown or other
  modified_base (293)..(293): a, c, t, g, unknown or other
  modified_base (299)..(299): a, c, t, g, unknown or other
  modified_base (363)..(363): a, c, t, g, unknown or other
  modified_base (378)..(378): a, c, t, g, unknown or other
  modified_base (381)..(381): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattntgtctctgtaccacaccaccaggacaaacgccccaaatcatnatttangatgtcagtgatccggccctgtaggggtttcaatcgcttctcctgctcgaacgtccgaacaacncggcctccctgaccntcncgtcgggctcgaggcgaggacgaggctagtatttactactcgactacctcaaggttactaacgaaacggacaagacccaaataaggttcggggtgttaccggggagggaaccggacaagtcgttacggtacccttcgtaacgggtcaccgcccgaaggtcccttacccggcccccgttacggtcccacgttcccgttcgtttaaccccc

SEQ ID NO: 424290 - DNA, 684 bp, Homo sapiens
  misc_feature: GZ8MTXP01B9ZMX.51.27.C05.1.454.CMB.2.raw
  modified_base (309)..(309): a, c, t, g, unknown or other
  modified_base (319)..(319): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcagtgacggtttggtaggttataattatgtctctaggtaccaacaccaccgaggacaaacgccccaaatcatgtatttangatgtcagtncgtcgcccgttgtaggggtttcaattcgtcttctccgtcggtctaccgtaacgtcccggaaaccaaccgtcccgggccctaccccgtagaaccctctccgttcgtcgggtccctaccgacgggaccggaagggaccgtaacgggtcgttagtactttaaacgtccgtcgaccctactactaaacgttaactaaacgaacgtacgaacgaaccgtaaaccgttaaggtttgggggtacggttccggggacggaaaccgggaacctaacgggccgttacggtacccggttccgttacggcccgaaccgcccggagtcccgtcccgtccccgtaggtcccttaccgttcccgttcccgttaacccccg

SEQ ID NO: 424291 - DNA, 655 bp, Homo sapiens
  misc_feature: GZ8MTXP01CH7EG.51.27.C05.1.454.CMB.2.raw
  modified_base (258)..(258): a, c, t, g, unknown or other
  modified_base (309)..(309): a, c, t, g, unknown or other
tcagcgatcgtatacacgaccggtgctcgatttagacgcgatcgaagggtttggggggctgggggtctcaggaggcagcgctctcgggacgtctccaccatggcctgggctctgctattcctcacccctcctcactcagggcacagggtcctgggcccagtctgccctgactcagcctgcctccgtgtcgtgggtctcctggacagtcgatcaccatctcctgcactggaaccagcagtgtacgttggtgttatattntgtctctagtaccaacaccaccagacaaacgcccccaaatcatgtatttangtatgtcaggtagacgtccggccttaggtacgggttacagtccgtcccttcgtcgtcggtccctaccgtaaaccggtcccgaaccgtaaccgacccggtacccctcccgtacgaccctacgtccctcgtccggccgttaccggacgggacccggaagggaccggtacgggtctacgttaacgttacttaccgtcgtacctaccctataaattaacgtacaaacgcaagaactaaacgtaggtttcgggtacggtaccgggagggaacggtaacaagtccgttacgaacccgttgacggttcgaccggtcgacgtccctccggcccttacggtaaccttcgttcccg

SEQ ID NO: 424292 - DNA, 714 bp, Homo sapiens
  misc_feature: GZ8MTXP01A26MH.51.27.C05.1.454.CMB.2.raw
  modified_base (439)..(439): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtacacaccaccagacaacgccccaaatcatgatttatgatgtacagtgactccggtcctgtacggggtttacgaacttcggtccctttctcgtcggtccctaccgaaaacggttccccggaaccaaaccgtacccgggccccttacccgtacgaaccctactccgtccgtcgggtccncccggagggacccggaagggtaccggaggtccgtaggttactttaacgtttaacgcgtaacccaccgttaacgtaactaacttaaacccgaagtaccgaacgtaacctaaaacggtaagggttttcgggggttccggttaaccgggggaacgggggtaaaccgggaacccttaagggtaccgttaccggtaaccccggttacgttaccggcgaccggtaacccccggaagtcccgtacccggtcccccgttcgggtaacccgttcctttccccgg

SEQ ID NO: 424293 - DNA, 746 bp, Homo sapiens
  misc_feature: GZ8MTXP01D30TY.51.27.C05.1.454.CMB.2.raw
  modified_base (232)..(232): a, c, t, g, unknown or other
  modified_base (254)..(254): a, c, t, g, unknown or other
  modified_base (557)..(557): a, c, t, g, unknown or other
tcagcgatcgtatacacgaccggtgctcgatttagacgcgatcgaagggttttgggggctggggtctcaggaggcagcgctctcgggacgtctccaccatggccctgggctctgctattcctcaccctcctcactcagggcacagggtcctgggcccagtctgccctgactcagcctgcctccgtgtctgggtctcctggacagtcgatcaccatctcctgcactggaaccngcagtgacggttgtgttatatntgtctctgacacaccaccaggacaacgccccaactcatagtatttatgaattgtactaggtgtaccgttcccggtcccgttacggttaagggggtttcgaacttccgtcctttccgttcgtacggtacccttacccggtaaaaccggttcccggaaccgtaaccgaccccgggtacccctcccgtactacccgacttcttccgtcgggtcccaccggaccggggaccggagggaaccgggtacggtccgttaggtatttactacgtacggtaccctaaccgttctaaagtttaacaacgaaanccgaacgtaaccttaaaacggtaggtttccgggggttgggttacccgggggaaggggtaaacccggggaacgaaccgggttccgaccgggtacccgttaaccgggttacggttacccgaccggaaaccccggtacggtccccgttccccggtcccccggttaaggttccccgttcccttttcccccggg

SEQ ID NO: 424294 - DNA, 727 bp, Homo sapiens
  misc_feature: GZ8MTXP01DB5JI.51.27.C05.1.454.CMB.2.raw
  modified_base (226)..(226): a, c, t, g, unknown or other
  modified_base (250)..(250): a, c, t, g, unknown or other
  modified_base (299)..(299): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataattntgtctctggtaccaacaccaccaggcaaacgccccaaatcatgatttangatgtcagtgactccggtcccgttcgtaggggtttacaatcgtctttctccgtcggctaccgaacggtcccggaaccaaccgccggtccctcccgtacgtaaccctactccgttcgcggggtccctacccgacgggaccccgaaggggacggtaaacgggccttaggttaaactttacgtttaaccgtcgtacctaaccttactaaacgttaacgtaaacgaacgacgaaacgtaaccgtaaacggtttaacgggttacgggggttacggttaccggggaaccgggtaaccggggtaaaccgtaacggtccggttaaccgggtaacccggttaccggtaaacggtacccgaccggacccggttaaccggtcccgtaccccgtccccggttacggtacccgttacccgttccccgttcccgttcccccg

SEQ ID NO: 424295 - DNA, 677 bp, Homo sapiens
  misc_feature: GZ8MTXP01DXU9C.51.27.C05.1.454.CMB.2.raw
  modified_base (231)..(231): a, c, t, g, unknown or other
  modified_base (252)..(252): a, c, t, g, unknown or other
  modified_base (259)..(259): a, c, t, g, unknown or other
  modified_base (287)..(287): a, c, t, g, unknown or other
  modified_base (292)..(292): a, c, t, g, unknown or other
  modified_base (298)..(298): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcacccctcctcactcagggcacagggtcctgggcccagtctgccctgactcagcctgcctccgtgtcgtggtctccgtggacagtcgatcaccatctcctgcagtggaacngcagtgacgttgtgttatatntgtctcngtacacaccaccagacaacgccccaaancatanatttangatgtacagtgctaccggccttaggtagggtttacagttccgtccgttacctcgtcggtcctaccgtaaacggtcccggaacaaaccgtacccgggtaccccttccgacacccgtaattccgtcggtcgggcctacccggagggacccggaaggtacggtacggtccgtaggttaaactttacgtttaccagtacccctaccgttaataacgtttaacgaacaacggaccaacggaactaaacggtttggttaggggttcggtacgggaccgggaaacgggcttaaacgcgttacggaaaccgttccgttaacggttccgaccgtaaccggtacggtccccgtcccggtccccgttcggtaaccttccgtttaaccccg

SEQ ID NO: 424296 - DNA, 625 bp, Homo sapiens
  misc_feature: GZ8MTXP01E0ENL.51.27.C05.1.454.CMB.2.raw
  modified_base (304)..(304): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgtacgttggtgttataatatgtctctggtaccaacaccaccagacaaacgcccccaaatcatgatttangatgtcagtgactccggcctagtaggggtttcgaatccgtcttctcgtcggctacccgaaaagtcccggctaaacccgccgggcccctaccctgaccctatcctcgtggggcctccgacgggcccgagggaccgagggtctagtaattacttacgtcgcctaccgttcaattaacacaagcgaacgacaaacgtaggttcggggtacggttcggggacgggaacgggtaaccaaggtcttacggtacccgttcgttagggttccaaccggaacccgaacggtcccttccggccccccgttggtcccttaaccgtttccccg

SEQ ID NO: 424297 - DNA, 643 bp, Homo sapiens
  misc_feature: GZ8MTXP01EOJ30.51.27.C05.1.454.CMB.2.raw
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttgtgttataatatgtctctgtaccaacaccaccagacaaacgccccaaatcatgtatttatgatgtcagtgactcggcctgtagggttcaatcgtccttctctggcctccaaacggtccgctaaaccgaccggtccctccctacgacctagttcctcgtcgggtcctcccgacgggccgaagggacggacggtcctaggtaatttacgttaccgtagaccctaaccgtactaaacgtaacttaaaccgaacggaccaaacgtacgaaaaccgttaaaggtttcggggtaacgggttccggggacggggaaacgggtaaccaaacggtcgttacggaacccggttcgttacgggccacggtaacccgaggtccgtaccggccccttaggtcccttcgttccccg

SEQ ID NO: 424298 - DNA, 600 bp, Homo sapiens
  misc_feature: GZ8MTXP01DHV33.51.27.C05.1.454.CMB.2.raw
  modified_base (250)..(250): a, c, t, g, unknown or other
  modified_base (330)..(330): a, c, t, g, unknown or other
  modified_base (373)..(373): a, c, t, g, unknown or other
  modified_base (445)..(445): a, c, t, g, unknown or other
  modified_base (455)..(455): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttataattntgtctctggtaccaacaccaccaggcaaagaccccaaatcatgatttatgatgtcagtgatcggccctgtagggggtttnaaactcgcttctccgtggacttccaaacgtcccggaacaaacnccggccctccctgacccaagtctcgtcgggctaccgaggcccgagggaccgaaggctagtactttattaccncactaactanaagtaactaacaaagacaagtaacgaacgtaaggttagggttcggttcgggacgggacgggaacgaacgtacgttacgtaccgttacgtacgtacgacgaccgaacgtccgtccgtcccgtcgtccttacctccgttccgtcccg

SEQ ID NO: 424299 - DNA, 539 bp, Homo sapiens
  misc_feature: GZ8MTXP01E0UEP.51.27.C05.1.454.CMB.2.raw
  modified_base (230)..(230): a, c, t, g, unknown or other
  modified_base (254)..(254): a, c, t, g, unknown or other
  modified_base (280)..(280): a, c, t, g, unknown or other
  modified_base (291)..(291): a, c, t, g, unknown or other
  modified_base (296)..(296): a, c, t, g, unknown or other
  modified_base (380)..(380): a, c, t, g, unknown or other
  modified_base (391)..(391): a, c, t, g, unknown or other
  modified_base (406)..(406): a, c, t, g, unknown or other
  modified_base (409)..(409): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatctcctgcactggaaccngcagtgtacgttgtggttatattntgtctctgacacaccaccagacaacnccccaatcatntattngatgtcagtgactccggcctgtacgggttcacgtcgtcttcgtcgtcgcctaccgaacgtccgcacgccgtccctcctgacctntcgtcgcgccncgacggcgaggacgngtntagtattacgtactcgccacgtcaatacgacagcagacctaaagtgttgggtagtcgggacggaaggaaccttagcgttacgaccgtcgacgcacgccgagtcccgtccgccccgttgtccttcctcccg

SEQ ID NO: 424300 - DNA, 588 bp, Homo sapiens
  misc_feature: GZ8MTXP01CBFLB.51.27.C05.1.454.CMB.2.raw
  modified_base (251)..(251): a, c, t, g, unknown or other
  modified_base (422)..(422): a, c, t, g, unknown or other
tcagcgatcgtatacacgaccggtgctcgatttagacgcgatcgaagggtttgggggggcctcaggaagcagcatcggaggtgcctcagccatggcatggatcccctctcttcctcggcgtccttgcttactgcacaggatttgtggcctcctatgagctgactcacgccaccctccgtgtccgtgtccccaggacagacagccagcgtcacctgctcgtggggataaattgcgcgatagatatcgtttcngtatcaaacagaacgccagccacgtccctgtcgtgtcatactatacaagacaaccaaagccggaccctcaaggggacttccccgagaacggcactttccctcgtgactacccaaactcgtagggaacacctaagccctaacgtcagaacatcaacggcgggacgcgaacgngtgtgagtagagcgtgtactttaacttggttacgaggacggtggaacgacgacgacaacgtcgtcggtcggttcgggcgggggaaccggaaacgcgtcgaccgtaccgttcgacgccgacccgaacggccgtccgccccgtccggttcctaaccgttccttccccg

SEQ ID NO: 424301 - DNA, 639 bp, Homo sapiens
  misc_feature: GZ8MTXP01BH8LC.51.27.C05.1.454.CMB.2.raw
  modified_base (304)..(304): a, c, t, g, unknown or other
  modified_base (454)..(454): a, c, t, g, unknown or other
  modified_base (496)..(496): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgtacgttggtgttataattatgtctctgtaccaacaccaccagacaaacgcccccaaactcatgatttangatgtacagtgactcggccctcggtacggggtttacaacgtcgtccttctcgtggtcctacccgtaaacgtcccggccaaaccgtacccgggtccctccccgtagaccctacgttccctcgtcgggcctaccgacgggccgagggaacgnggctagtattacttacgtgacctacgtctaatactaacgaanacgtagacctaaagtaacggttgggtacggttccggggacgggtaacggacgaacggtcgttacggtacccggtcgttaggccaccgggccccttaagggccctcccgggtccccccggttacggtcccttcccggttccccg

SEQ ID NO: 424302 - DNA, 564 bp, Homo sapiens
  misc_feature: GZ8MTXP01CYXIP.51.27.C05.1.454.CMB.2.raw
  modified_base (227)..(227): a, c, t, g, unknown or other
  modified_base (252)..(252): a, c, t, g, unknown or other
  modified_base (361)..(361): a, c, t, g, unknown or other
  modified_base (369)..(369): a, c, t, g, unknown or other
  modified_base (412)..(412): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataattntgtctcctggtaccaacaccaccaggcaaacgccccaaatcatgtatttatgatgcagtgatcggccctcgagggtttcaatcgtcttctctggctcagtccgacaacncgcctccngacatctcgtcgggctcgaggccgaggacgagctgattatacncgctactcatactacaagcacacaacgtaagttcggggtcgttccgggacggacggaccaaggtcttacggtacccgttcgtacggtccaacgcccgaacggcccgtaccgcccccgtacggtccttaccgtccgttcccggtttccccccg

SEQ ID NO: 424303 - DNA, 706 bp, Homo sapiens
  misc_feature: GZ8MTXP01A6PD7.51.27.C05.1.454.CMB.2.raw
  modified_base (197)..(197): a, c, t, g, unknown or other
  modified_base (207)..(207): a, c, t, g, unknown or other
  modified_base (224)..(224): a, c, t, g, unknown or other
  modified_base (248)..(248): a, c, t, g, unknown or other
  modified_base (298)..(298): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacngtcgatcacntctctgcacgtgaaccngcagtgacgttggtagttatattntgtctcgtgtaccaacaccaccagacaaacgccccaaatcatgtatttangtatgtacaggtgacgtccggtcccttaggtacgggggtttacaacgtcgtctttcgtccgtcggacctacgacggtacccggaactaaacccgccggtaccctccctcgacctactccgtcgtcgggaccgtccggggaccgagggcgaggtctaggtattactcgtcgactacctataattaacaacgaaggtaccaacgggtaacctaaaacgttacgggtttaggggttacggggttaccgggtaacggggtacgggaaaccctagggtaacccgtacgggttaccccgttaccggttacgggaaccgacccggaacccgttaacgggttccccgtcccccggtccccggttaaccgggttccctacccgtttacccgttccccggttaacccccgttcccccg

SEQ ID NO: 424304 - DNA, 637 bp, Homo sapiens
  misc_feature: GZ8MTXP01AG3KL.51.27.C05.1.454.CMB.2.raw
  modified_base (229)..(229): a, c, t, g, unknown or other
  modified_base (305)..(305): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatccacatctcctgcactggaaccngcagtgacgttggtagttataattatgtctcgtgtacaacaccaccaggacaaacgcccccaaatcatgtatttangatgtacaggtgacgtccggccctaggttacgggggtttacaattccggtccttcgtcgtcggtcctacccgaaaacggttcccggaactaaacccgacccgggtccctcccgttacgacctactcctcgtcgggtcccacgacgggccgaggacggaggtctacgtaatttactacgtcacctacgtactaactaacaacaacgacagaacgtaaacgtaaggttggggtacgttcgggacgggaacggaacgacgtaccgttcggtaacccgttcggttagttccgacgaacccgtagccgtcccgccccggttcgtcaacccgtttccc

SEQ ID NO: 424305 - DNA, 668 bp, Homo sapiens
  misc_feature: GZ8MTXP01ANA3I.51.27.C05.1.454.CMB.2.raw
  modified_base (210)..(210): a, c, t, g, unknown or other
  modified_base (224)..(224): a, c, t, g, unknown or other
  modified_base (231)..(231): a, c, t, g, unknown or other
  modified_base (244)..(244): a, c, t, g, unknown or other
  modified_base (289)..(289): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcgtggacagtcatcaccntctctgcatgaacngcagtgngttgtgttatatntgtctctgtaccacaccacagacaacgccccaatcatgtatttangatgtacagtgacgtcggccgtagtagggggtttcaagttccgtcctttctcgtcggaccctacccgtaaaccggttcccggaacaaacccgtacccgggtccctaccccggtacgaccctacttccgttccgttcgggaccttccggaacgggaccggaacgggaccggtacggtacctttaggtaactttacgtaccgttcgacccttaccgtactaaacgtactaacgaacgtacaacgtaactaaaccgtaaggttcgggtacggtacgggaccgggaacggtaccaaggtccgttacggtacccgtcgttacggttcgaccggtcccgaacggtccgtaccccggtccccgttacggtccttaaccgtttcccg

SEQ ID NO: 424306 - DNA, 672 bp, Homo sapiens
  misc_feature: GZ8MTXP01AFLWG.51.27.C05.1.454.CMB.2.raw
  modified_base (233)..(233): a, c, t, g, unknown or other
  modified_base (297)..(297): a, c, t, g, unknown or other
  modified_base (303)..(303): a, c, t, g, unknown or other
tcagcgatcgtatacacgaccggtgctcgatttagacgcgatcgaagggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccngcagtgacgttggtgtatattatgtctctgtacaacaccaccaggcaaacgccccaaatcatanatttangactgttacgagttcgatccggcctcgtagggggtttacagtccgtcttcgtcgtcgtactaccgaaacgttcccggaactaaaccgacccgggtccctacccgttacgaacctctcccttggtccggggtcctaccggaacgggccgggaaacggaccgggaggtacctgggttaaactttagttaacctcgttaccaacccgttataacgttaacaaccgtaaaagcctaacggaactaaaccgtacggttaggggtacgttcggggacggaaagggaccgaggtaccgttgtaaccccgttagttaccggcgacgtaacccgggacgtccgtcccggtccccgttcggtcccttaacgttcccccg

SEQ ID NO: 424307 - DNA, 635 bp, Homo sapiens
  misc_feature: GZ8MTXP01A5G22.51.27.C05.1.454.CMB.2.raw
  modified_base (202)..(202): a, c, t, g, unknown or other
  modified_base (212)..(212): a, c, t, g, unknown or other
  modified_base (228)..(228): a, c, t, g, unknown or other
  modified_base (251)..(251): a, c, t, g, unknown or other
  modified_base (253)..(253): a, c, t, g, unknown or other
  modified_base (401)..(401): a, c, t, g, unknown or other
  modified_base (461)..(461): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcatcaccntctctgcagtgaaccngcagtgtacgttgtagttatatntntctctgtacacaccaccagacaacgccccaaatcatgtatttatgatgtcagtgactcggtcctggtacgggttacatcgtccttctagtcgtcctaccgaaacgtcccggccaaccgtacccggtcccctacccgtacgtaaccctnttcctcggttcggcccgtacggacgggccggaggacggaggtcctaggtaattacttacncgtacctacgtactaagttaacaacaacggcaagacgtaaacgtaggtttcggggtacgttcgggaacggaacgggaaccaagtccgttcggtaaacccgtcgttaacggggccacggaaccccgtaacggtcccgttcccggccccgttaccggtaacccttccgtttccccg

SEQ ID NO: 424308 - DNA, 572 bp, Homo sapiens
  misc_feature: GZ8MTXP01EMD7C.51.27.C05.1.454.CMB.2.raw
  modified_base (228)..(228): a, c, t, g, unknown or other
  modified_base (289)..(289): a, c, t, g, unknown or other
  modified_base (302)..(302): a, c, t, g, unknown or other
  modified_base (398)..(398): a, c, t, g, unknown or other
  modified_base (428)..(428): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctccgtggacagtcatccacatctcctgcacgtgaacngcagtgtagttgtagttatatatgtctcgtagacaacaccaccgagacaaacgccccaaanctatagtatttangtatagtctagtgacgtccggaccgttaggtaagggtttcaatcgtcttctcgtgcctacgaaacgtccgaacaaccgaccgtccctacacgaccngtctcgtcgcctcgaggccgagacgagttntagtattactacactactactataagtacaacgagacaagaacgtaacgtggtcgggtgtacggaggaacgtacgagtcgttacgtacgtaacgacgacgaccgaaccgacgtcccgtccgtcccgttacgtccttccgtcccg

SEQ ID NO: 424309 - DNA, 646 bp, Homo sapiens
  misc_feature: GZ8MTXP01DL5V2.51.27.C05.1.454.CMB.2.raw
  modified_base (210)..(210): a, c, t, g, unknown or other
  modified_base (231)..(231): a, c, t, g, unknown or other
  modified_base (255)..(255): a, c, t, g, unknown or other
  modified_base (290)..(290): a, c, t, g, unknown or other
  modified_base (303)..(303): a, c, t, g, unknown or other
  modified_base (346)..(346): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcatcaccntcctcctgacacgtacgaacngctagtgtagttgtagttatatgntctctacgacacaccacgagaacaaccacccaatnagtattaatttgntatcgtatagtacgtacgtcccggacttagggtacgtttaacncgtccttcctccgttgacgtcctaacccgaaacgggtccgaaccaaacccgggtcccgacccttcccgagtaacccctgtccctccggtcggtccacggacggacggacggtacggacggttacgtagtaacttactacgactactacgtactaagtaacaacgacgacgaacgtaacgtaaagttaggttcgggtacgggtacgggaacggaacggtaacgacgtacgttacgtaccgtacgttaccgcgaccgaaccgaccgtcccgccccggtcccgttacgtaaccgttccgtccg

SEQ ID NO: 424310 - DNA, 584 bp, Homo sapiens
  misc_feature: GZ8MTXP01E4QCN.51.27.C05.1.454.CMB.2.raw
  modified_base (227)..(227): a, c, t, g, unknown or other
  modified_base (252)..(252): a, c, t, g, unknown or other
  modified_base (302)..(302): a, c, t, g, unknown or other
  modified_base (443)..(443): a, c, t, g, unknown or other
  modified_base (458)..(458): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataattntgtctcctggtaccaacaccaccaggcaaagcccccaaatcatgatttangatgtcagtgatccggcctgaggggtttcaatcgcttctcctggctcccgaagtcccggaacaaccgccgggccctccctacgaccatcctcgtcggggctacccgagggtaccgagggaccgagggctagattaactacngacacctcgagttanaacgtagcaagacaaagtaattcggggtagtcgggacggacgggaacccaaaggtcttagaccgttccgaaggtcagcccaagggcctccgtccccctaggtcccacgttcccgttcgttcccccg

SEQ ID NO: 424311 - DNA, 672 bp, Homo sapiens
  misc_feature: GZ8MTXP01A9CSK.51.27.C05.1.454.CMB.2.raw
  modified_base (210)..(210): a, c, t, g, unknown or other
  modified_base (231)..(231): a, c, t, g, unknown or other
  modified_base (258)..(258): a, c, t, g, unknown or other
  modified_base (613)..(613): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccntcctccgtgacatcggaaccngcgtagtgtacgttggtagttatattntcgtctcgtacgtaaccacaccacccgagacaaacgccccctaaatcatagatttatgatgtcgagtgacgtccgtaccgttcggtacgggtttcacttccgtcctttctcggttcgccgttacccgaacggtacccggtcaaacccgcccgtccccttaccgacgtaccctcgttcgttcgtccgggactaccggacggtcccggaggaccggtaagtccttagtattaactcgtacgacctaccgtataaacggttaacaacgaaacgcgtaaacgtacggtaaaccgttagggttgggttacggtcccggggagggaacccgggtaattaccggtcgttacggtaccccgtnttacgggccgacgtaaccgacgggtcctacccggcccgttacgtccttaaccgttcccg

SEQ ID NO: 424312 - DNA, 515 bp, Homo sapiens
  misc_feature: GZ8MTXP02IA2ZD.51.27.C05.1.454.CMB.2.raw
  modified_base (305)..(305): a, c, t, g, unknown or other
  modified_base (359)..(359): a, c, t, g, unknown or other
  modified_base (452)..(452): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggcaaacgcccccaaatcatgatttangatgtcagtgatcggcctgaggggtttcatcgctctctgctcaagtccgcaacncggcctccctgaccatctctgggcctccgaggccgaggacgaggctgatttatactgcacctcaatatacaaagcaagcaaacaagtttgggngttcggcggaggaccaagctagaccgtcaggtcacgcccaggcctcgccccctcggcactccg

SEQ ID NO: 424313 - DNA, 505 bp, Homo sapiens
  misc_feature: GZ8MTXP02GO2ML.51.27.C05.1.454.CMB.2.raw
  modified_base (306)..(306): a, c, t, g, unknown or other
  modified_base (448)..(448): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttangatgtcagtgatcggccctcaggggtttcaatcgcttctctggctcaagtccggcaacacggcctcctgaccatctctgggctccaggccgaggacgaggctgattatactgcacctcatatacaagcagcaacaattgggnttcggcgagggaccagctgaccgtccaggtcagcccgaaggctcgcccctggcactc

SEQ ID NO: 424314 - DNA, 551 bp, Homo sapiens
  misc_feature: GZ8MTXP02IS8EN.51.27.C05.1.454.CMB.2.raw
  modified_base (308)..(308): a, c, t, g, unknown or other
  modified_base (434)..(434): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaactcatgatttangatgtcagtgatcggccctcgaggggtttcaatcgcttctctgctcaagtccgcaacacggcctccctgaccatctcgtgggcctccaggcccgaggacgaggctgattatactgacacctcatanacaagcagacaaacgagttgggtagtcgggacggaacgggaccaaaggctacggaccgtccgtaagggtccacggaaccccgaaggccttccgcccccgtcggtacctaccttcccg

SEQ ID NO: 424315 - DNA, 569 bp, Homo sapiens
  misc_feature: GZ8MTXP02H1N0Z.51.27.C05.1.454.CMB.2.raw
  modified_base (304)..(304): a, c, t, g, unknown or other
  modified_base (360)..(360): a, c, t, g, unknown or other
  modified_base (415)..(415): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctgtaccaacaccacccaggcaaagcccccaaatcatgatttangatgtcagtgatcggcctcgaggggtttcaatcgcttctctgctcagtccgcaacncgccctcctgaccatctcgtggctccgaggcccgaggacgaggctagattatacngaccactacatatacaaagcaagactaaacgaagtttgggtacgttcgggacgggtaacgggacccaaaggccgttacggaacccggttaccgtacgggtaccacggaacccgaagggcccttaccggccccccgttccggtccaccgttcccg

SEQ ID NO: 424316 - DNA, 579 bp, Homo sapiens
  misc_feature: GZ8MTXP02FIS2I.51.27.C05.1.454.CMB.2.raw
  modified_base (271)..(271): a, c, t, g, unknown or other
  modified_base (286)..(286): a, c, t, g, unknown or other
  modified_base (305)..(305): a, c, t, g, unknown or other
  modified_base (520)..(520): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgtataatatgtctctgtacaacacactcacgnaacacccaacctacnagattatgatgtcagtgancgtcccgtctagggttcggtaactacgtcttccttctcggcgtcctaacgtaccggtcgaccaaccggcccgtccctcgaccactctctcgggcgtcccacgggccggacgggaacggacggcgtcgtaagtttattactgccaccctctactaattacaaacggcacgacaactaaagtttggggtggttacggcggggaagggaccgaaacgngtacgaccgtccgtacggtacacgaccaacggctcgcccccgtcggtcacctcttcccg

SEQ ID NO: 424317 - DNA, 529 bp, Homo sapiens
  misc_feature: GZ8MTXP02IH2MV.51.27.C05.1.454.CMB.2.raw
  modified_base (303)..(303): a, c, t, g, unknown or other
  modified_base (377)..(377): a, c, t, g, unknown or other
  modified_base (446)..(446): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccaccaggcaaagcccccaaatcatgatttangatgtcagtgatcggcctcgagggtttcaatcgccttctctgctcaagtcgcaacacggcctccctgaccatcnctgggcctccgaggccgaggacgaggctgattatactgcactcatatacaagcaagcaacaattggggngttcggcggaggaccgtaaagctcggaccgttccgtacggtcacggaacccgaaggcctcggccccctcggtaccacgttccg

SEQ ID NO: 424318 - DNA, 501 bp, Homo sapiens
  misc_feature: GZ8MTXP02IO2B4.51.27.C05.1.454.CMB.2.raw
  modified_base (353)..(353): a, c, t, g, unknown or other
tcagcgatcgtatacacgaccggtgctcgatttagacgcgatcgaagggtttggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtccccctgtcgtggtcatctatcaagacaccaagcggcccctcagggatcccctgagcgattcctctggctccaactctgggacncagccactctgaccatcagcgggacgcaggctgtggatgaggctgactttactgtcaggcgtgggacagcgacactgcgtgtcggcgggggaccagctcgaccgtcctcggtcagcccaaggctcgccccctcggtccacgtcttccg

SEQ ID NO: 424319 - DNA, 556 bp, Homo sapiens
  misc_feature: GZ8MTXP02HCNYI.51.27.C05.1.454.CMB.2.raw
  modified_base (251)..(251): a, c, t, g, unknown or other
  modified_base (303)..(303): a, c, t, g, unknown or other
  modified_base (340)..(340): a, c, t, g, unknown or other
  modified_base (357)..(357): a, c, t, g, unknown or other
  modified_base (366)..(366): a, c, t, g, unknown or other
  modified_base (371)..(371): a, c, t, g, unknown or other
  modified_base (416)..(416): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattntgtctctggtaccaacaccacccaggcaaacgcccccaaactcatgatttangatgtcagtgatcggccctgagggttcaatcgcttcnctgctcagtccgacacncggcctccngaccntctcgtcgggctccgaggccgaggacgaggctagtattacttacncgctacctctaatacaacgacgacacgaactaacgtaggttgggtaggtacgggacgggtacggaactacgcgtacgaccgtcgtacggacaccggaccgacgtcgtcccgtcccgtcgacctccgtcgttccctccccg

SEQ ID NO: 424320 - DNA, 521 bp, Homo sapiens
  misc_feature: GZ8MTXP02JW5OB.51.27.C05.1.454.CMB.2.raw
  modified_base (300)..(300): a, c, t, g, unknown or other
  modified_base (361)..(361): a, c, t, g, unknown or other
  modified_base (448)..(448): a, c, t, g, unknown or other
tcagcgatcgtatacacgaccggtgctcgatttagacgcgatcgaagggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttangatgtcagtgatcggccctcaggggtttcaatcgcttctcctggctccaagtccggcaacncggcctccctgaccatctctgggctccaggcccgaggacgaggctgatttatactgcacctcatatacaagcagcaacaattgggtnttcggcggagggaccaaggctgaccgtctaggtcacgcccaaggctcgccccctggtccactctcgttccccg

SEQ ID NO: 424321 - DNA, 503 bp, Homo sapiens
  misc_feature: GZ8MTXP02H6I1E.51.27.C05.1.454.CMB.2.raw
  modified_base (360)..(360): a, c, t, g, unknown or other
  modified_base (376)..(376): a, c, t, g, unknown or other
  modified_base (440)..(440): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaaactcatgatttatgatgtcagtgatcggccctgaggggtttcaatcgcttctctgctcaagtccgcaacncgcctcctgaccatcnctggctcaggccgaggacgaggctgattatactgcactcatatacagcagcaaacaagttgggngttcggcgaggaccaagctagaccgtcagtcacgccaggctcgcccctggcactctcgtcccc

SEQ ID NO: 424322 - DNA, 535 bp, Homo sapiens
  misc_feature: GZ8MTXP02F1L4I.51.27.C05.1.454.CMB.2.raw
  modified_base (306)..(306): a, c, t, g, unknown or other
  modified_base (420)..(420): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaacgcccccaaatcatgatttangatgtcagtgatcggccctgaggggtttcaatcgcttctctggctccaagtccggcaacacggcctccctgaccatctctgggctccgaggccgaggacgaggctgattatacngcacctcatatacaagcagacaaactaagttgggagttcggcggaacggaccgaaaggctaggaccgtcctaggtcacgaacccgaaggcctacgccccctgggtccacgttccg

SEQ ID NO: 424323 - DNA, 614 bp, Homo sapiens
  misc_feature: GZ8MTXP02JP42A.51.27.C05.1.454.CMB.2.raw
  modified_base (230)..(230): a, c, t, g, unknown or other
  modified_base (404)..(404): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttatattatgtctcctgtaccaacaccaccaggcaaacgcccccaaactcatgatttatgatgtcagtgatcggcctcgaggggtttcaatcgccttctctgctcagtccggcaacgacgcctcctgaccatctcgtggcctcgacggccgaggacgnggctcgtaattacgtactgacctacctcgatactacaagcaagacaaacgtaaggtttgggtacggttacgggacggggaaacggacccgaaaaggtcccgtaacggaccccggttacccgtaaacgggttcccgaaacggaacccccggaaacgggtcccgttaccccgggcccccccgtttaccgggtccccgtaaccttttcccccg

SEQ ID NO: 424324 - DNA, 584 bp, Homo sapiens
  misc_feature: GZ8MTXP02JP912.51.27.C05.1.454.CMB.2.raw
  modified_base (305)..(305): a, c, t, g, unknown or other
  modified_base (397)..(397): a, c, t, g, unknown or other
  modified_base (421)..(421): a, c, t, g, unknown or other
  modified_base (432)..(432): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttangatgtcagtggcgccgtcctagggttcggtaatacgtctccttctcgcgtcctaacgtaacggcgacgaaccgccgtccctcgacactctcngtcgtccacgcgacgacggagcgngtatattatcncactactatataacaacgacacgtaacaaactaaggttagggttacgggttacgggtacgggacgggaaccgaacgtacgtacggtaccggtaccgtacggtacgacgacccgaacgtacgtcccgtccccgtccggtacctcctacgtccg

SEQ ID NO: 424325 - DNA, 529 bp, Homo sapiens
  misc_feature: GZ8MTXP02GFLO6.51.27.C05.1.454.CMB.2.raw
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggcctcaggggtttcgaatcgcttctctgctcaagtccggcaacacggcctccctgaccatctctgggctccgaggccgagacgaggctgattatactgcacctcatatacaaagccagcaaactaaagttgggtgttcgggcggaacggggaccaaagctagaccgtcctaaggtcagcccgaaaggctcgccccctggtccacttccg

SEQ ID NO: 424326 - DNA, 633 bp, Homo sapiens
  misc_feature: GZ8MTXP02GOZ4V.51.27.C05.1.454.CMB.2.raw
  modified_base (250)..(250): a, c, t, g, unknown or other
  modified_base (298)..(298): a, c, t, g, unknown or other
  modified_base (342)..(342): a, c, t, g, unknown or other
  modified_base (367)..(367): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctgtaccaacaccaccagacaaacgccccaaatcatgatttangatgtcagtgactcggccctagtaggggtttacaatcgctttcncctggcctacaagtccggacaaacncggccctcctgaccctatctcgtcgggcctccgacggcccggaaggacgaacggtctgtaatttaacttaccagacctaacctcaaattaactaacaacgacaagaccaaaagtaaggtttggggtggttaccgggacgggaacggaacccaaaggtcctacgggtaaccccggttaccgtaacgggtccgaaaccggacccaaacgggcccgttcccgacccccgttaccgggtcccaccgtttcccgttcccggtttccccccg

SEQ ID NO: 424327 - DNA, 564 bp, Homo sapiens
  misc_feature: GZ8MTXP02J2VAA.51.27.C05.1.454.CMB.2.raw
  modified_base (457)..(457): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagacaccaagccggccctcgagggactccctgacgcgattccctctggcctccaactcgtaggggaccacgaacgcccaactcctacgaacccatccgaacggccggggaccgacgacgggcctggggtaggaagtggaacgggtcttagtacctttttacgngtcgagggcgtagggacagcgacacgtcgcggtgtcggggcggggacagcgcgaccgtcgtcgccacgcccgaaggcctccggccccctcggtccaccgtcgtcccg

SEQ ID NO: 424328 - DNA, 631 bp, Homo sapiens
  misc_feature: GZ8MTXP02JOOF6.51.27.C05.1.454.CMB.2.raw
  modified_base (230)..(230): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacaccaccaggacaaacgcccccaaatccatgatttatgatgcagtgactccggccctcgtaggggtttcgaacgtcgtccttctcgtcgtcctacgtacggtcccgacaaccgaccggtccctcccgtacgaacctcttcctcggtcggccctaccggacgggaccggacgggacggacggtacgtagttaactttacttacgtctaccctacctacaacttacaacgaagcaacaaccaaagtaggttcgggttacggtcgggacgggacggaaccgacgtcgtaccggtacccgttaccggttacggaccgaccgaaccgaacggtccgtccccgtccccgtcggtaccacccgtttcccg

SEQ ID NO: 424329 - DNA, 524 bp, Homo sapiens
  misc_feature: GZ8MTXP02JA7P3.51.27.C05.1.454.CMB.2.raw
  modified_base (230)..(230): a, c, t, g, unknown or other
  modified_base (367)..(367): a, c, t, g, unknown or other
  modified_base (377)..(377): a, c, t, g, unknown or other
  modified_base (430)..(430): a, c, t, g, unknown or other
  modified_base (518)..(518): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctggtaccaacaccaccaggacaaacgcccccaaactcatgatttatgatgtcagtgatcgcctcgtaggggtttcaatcgccttctcgtcgctcaacgtccgcaacncggcctcccngaccatctctggcctccgaggccgaggacgaggctagattatactcgcacctnatatacaagcagacaaacgtagtgggtgtcggcggacggaccagctcgaccgtcgtaggcagcccgaaggcctacgcccctcgtaccncttccg

SEQ ID NO: 424330 - DNA, 508 bp, Homo sapiens
  misc_feature: GZ8MTXP02HDFUC.51.27.C05.1.454.CMB.2.raw
  modified_base (412)..(412): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccagcaaacgcccccaaatcatgatttatgatgtcagtgatcggccctcgtaggggtttcaatcgcttctctgctcagtccgcaacacgcctcctgaccatctctggcctcgaggcgaggacgaggctgattatacngccactcatactacaagcagacaacagttgggtgtcggcggacggaccagctggacctcgacgtcacgccgaggctaccgcccctcggccactccg

SEQ ID NO: 424331 - DNA, 510 bp, Homo sapiens
  misc_feature: GZ8MTXP02IRM0B.51.27.C05.1.454.CMB.2.raw
  modified_base (333)..(333): a, c, t, g, unknown or other
  modified_base (344)..(344): a, c, t, g, unknown or other
  modified_base (350)..(350): a, c, t, g, unknown or other
  modified_base (358)..(358): a, c, t, g, unknown or other
  modified_base (364)..(365): a, c, t, g, unknown or other
  modified_base (368)..(368): a, c, t, g, unknown or other
  modified_base (376)..(376): a, c, t, g, unknown or other
  modified_base (378)..(378): a, c, t, g, unknown or other
  modified_base (380)..(380): a, c, t, g, unknown or other
  modified_base (383)..(383): a, c, t, g, unknown or other
  modified_base (387)..(387): a, c, t, g, unknown or other
  modified_base (389)..(389): a, c, t, g, unknown or other
  modified_base (401)..(401): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaaattgcgcgatagatatgtttcctggtatcaacagaagccaggccagtcccctgtcgtggtcatctatcaaagacaccaaagcggccctcaggatccctgagcgattcnctgctcaatcnggacanagccatcngaccannagngacgcagngngngangagntntattatgtcagngaggagagacgacactcgcgtcgtcgggacggggaccggaacgacgacgaccgtaccgtcgtacgacgaccgaacgacgtaccgtcccgtaccggtccgtacgtcgtcg

SEQ ID NO: 424332 - DNA, 546 bp, Homo sapiens
  misc_feature: GZ8MTXP02HAK6V.51.27.C05.1.454.CMB.2.raw
  modified_base (299)..(299): a, c, t, g, unknown or other
  modified_base (341)..(341): a, c, t, g, unknown or other
  modified_base (365)..(365): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttataattatgtctcctggtaccaacaccacccaggcaaagcccccaaatcatgatttangatgtcagtgatcggccctgtaggggtttcgaatcgctttcncctggcctcgaagtccggacaacnccggccctccctgacccagtctcgtgggcctccgaggccgaggacgagctgattattactgcactcatatacaagcagcaaacaagttggtgttcgggacggaggaccaaagctagaccgtcgtaacggtcgaacgcccgaaaggcctcgtccccctcggtaccacctcgtccgttccccc

SEQ ID NO: 424333 - DNA, 557 bp, Homo sapiens
  misc_feature: GZ8MTXP02F7H8D.51.27.C05.1.454.CMB.2.raw
  modified_base (305)..(305): a, c, t, g, unknown or other
  modified_base (344)..(344): a, c, t, g, unknown or other
  modified_base (364)..(364): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaagcccccaaactcatgatttangatgtcagtgatcggcctcgaggggtttcaatcgcttcnctggctcaagtccggcaacncggcctccctgaccatctctgggcctccgaggcccgaggacgaggctagattatactgccacctcatatacaagcagacaaactaagttggggtgttacgggcggaacggggacccaaaggcgttacgaacccgtcctagggtccacggccccgaaagggtcctccggccccctcgggtacctaccgtttccg

SEQ ID NO: 424334 - DNA, 524 bp, Homo sapiens
  misc_feature: GZ8MTXP02HI1TN.51.27.C05.1.454.CMB.2.raw
  modified_base (303)..(303): a, c, t, g, unknown or other
  modified_base (380)..(380): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccagcaaacgcccccaaatcatgatttangatgtcagtgatcggcctcgaggggtttcaatcgccttctctgctcaagtccggcaacacggcctccctgaccatcncgtggcctccgaggccgaggacgaggctgattatactgcactcatatacaagcaagcaaacgtagttgggtacgtcggacggacggaccaagctacgaaccgtcctaggccagcccgaaggcctcgccccttcggctacttccg

SEQ ID NO: 424335 - DNA, 550 bp, Homo sapiens
  misc_feature: GZ8MTXP02HHBPQ.51.27.C05.1.454.CMB.2.raw
  modified_base (342)..(342): a, c, t, g, unknown or other
  modified_base (403)..(403): a, c, t, g, unknown or other
  modified_base (425)..(425): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctgtaccaacaccaccagcaaacgcccccaaatcatgatttatgatgtcagtgatcggccctgaggggtttcaatcgccttcnctggctcgagtccgcaacacggcctcctcgaccatctcgtggcctccgaggccgaggacgngctgtattatactgactacctntaatatacgaaagcagacaaacaagttgggtacgttcgggacggaagggacccaaagccgtacggacccgtccgtaacggtccgacgaacccgaaggcctccgcccccgtcggtcctaccttccg

SEQ ID NO: 424336 - DNA, 553 bp, Homo sapiens
  misc_feature: GZ8MTXP02GQQIG.51.27.C05.1.454.CMB.2.raw
  modified_base (303)..(303): a, c, t, g, unknown or other
  modified_base (342)..(342): a, c, t, g, unknown or other
  modified_base (359)..(359): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggcaaacgcccccaaactcatgatttangatgtcagtgatcggccctgaggggtttcaatcgcttcnctgctcagtccgcaacncggcctcctgaccatctctgggcctccgaggccgaggacgagctgattatactgcacctcaatactacaagcagacaacgtaagttgggtcgttcggacgggacggacccaaggcgttcggaacccgttccgtaggtaccacgacccgaaggcccgtccggcccccgttcggtccaccttcgtccgtttccccc

SEQ ID NO: 424337 - DNA, 565 bp, Homo sapiens
  misc_feature: GZ8MTXP02IQM0V.51.27.C05.1.454.CMB.2.raw
tcagcgatcgtatacacgaccggtgctcgatttagacgcgatcgaagggtttggggggcctcaggaagcagcatcggaggtgcctcagccatggtatggatccctctcttcctcggcgtccttgcttactgcacaggatttgtggcctcctatgagctgactaagccaccctccgtgtccgtgtccccaggacagacagccagcgtcacctgctctggggataaattgcgcgatagatatgttcctgtatcaacagaagccaggccagtcccctgtcgtggtcatctatcaaagacaccaaagccggccctcaggactccctgacgcgattctctggcctccaactctagggaaccacagccactctacgacccaatcagcggggatcgcgaggctggaggagtggacgtctacgtacttttacgtcgtacgagggtcggtacggacgacgcgaactcgtcgtccggtggtccggggacggggacacgcgtacgccggtccgtcggtacaccgtaccgacggtccgtcccgtccccggtcgtccgaccttccgtccgttcccccg

SEQ ID NO: 424338 - DNA, 540 bp, Homo sapiens
  misc_feature: GZ8MTXP02FPTLW.51.27.C05.1.454.CMB.2.raw
  modified_base (301)..(301): a, c, t, g, unknown or other
  modified_base (360)..(360): a, c, t, g, unknown or other
tcagcgatcgtatacacgaccggtgctcgatttagacgcgatcgaagggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggacaaagcccccaaactcatgatttangatgtcagtgatcggccctcgaggggtttcaatcgcttctcctgctcaagtccgcaacncggcctccctgaccatctctgggctccgaggccgaggacgaggctgatttatactgcacctcaatataacaagcaagacaaactaagttggggtgttcggacgggaggggaaccaaggctacggaccgtctacgggtcacgcccgaaaggcctcgccccctcggctacctctcgttcccc

SEQ ID NO: 424339 - DNA, 520 bp, Homo sapiens
  misc_feature: GZ8MTXP02HOM9R.51.27.C05.1.454.CMB.2.raw
  modified_base (317)..(317): a, c, t, g, unknown or other
  modified_base (320)..(320): a, c, t, g, unknown or other
  modified_base (326)..(326): a, c, t, g, unknown or other
  modified_base (332)..(332): a, c, t, g, unknown or other
  modified_base (345)..(345): a, c, t, g, unknown or other
  modified_base (350)..(350): a, c, t, g, unknown or other
tcagcgatcgtatacacgaccggtgctcgatttagacgcgatcgaagggtttgggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgttcctggtatcaacagaaagccaaggccagtcccctgtcgtggtcatctatcaagacaccaagcggcctgggatccngancgatcncctgcncaactctggaacncgacncactcacacacacacgcggacgcgagcgtgtgagtaggagcgtacgttacgtttacgtgtcgtaggtcggtagggacgacgacgacgacgtcgcggtcggtcgggacggggacgacgcgcgcgtccgtcgtcgacgaccgacgccgccgcccgtccgtcgtctctctccc

SEQ ID NO: 424340 - DNA, 591 bp, Homo sapiens
  misc_feature: GZ8MTXP02HND0M.51.27.C05.1.454.CMB.2.raw
  modified_base (567)..(567): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccgaagccggccctcgacgggactcccgtagacgcgtattcctcgtggcctaccaactcgttacggggaaccaccgaagcccactcctacgaaccctatccgaaggcccggggaaccgccgaagggtcctggtaggattagggacgggtcctaggttactttttaccgtgttaccgtagggccggtgggacaggcgactacgtcggcccgttgggttccggggcgggggaaccaggccgttacgaccgtccgtcgcacgccgaacgtcnccgcccccgtgcctcgtcgtcccg

SEQ ID NO: 424341 - DNA, 532 bp, Homo sapiens
  misc_feature: GZ8MTXP02HEYCL.51.27.C05.1.454.CMB.2.raw
  modified_base (300)..(300): a, c, t, g, unknown or other
  modified_base (337)..(337): a, c, t, g, unknown or other
  modified_base (357)..(357): a, c, t, g, unknown or other
  modified_base (412)..(412): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccaacaccaccaggcaaagcccccaaactcatgatttangatgtcagtgatcggccctgagggttcaatcgcttcncctgctcagtccggacaacncggcctcctgaccatctcgtgggctccgaggccgaggacgaggctagattatacngcactcatatacaagcaagacaaacgagttgggtgttcggacggtagggacccaaagcgtgacccgtcgtaggtccacgcccaaggcctccgccccctcggtccactcgtcgttcccccg

SEQ ID NO: 424342 - DNA, 544 bp, Homo sapiens
  misc_feature: GZ8MTXP02HZZP9.51.27.C05.1.454.CMB.2.raw
  modified_base (406)..(406): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccacgtcccctgtcgtggtcatctatcaagaccaaccaagccggcccctgagggactcccgtgacgcgtattccctcgtggcctccaactccgtagggaccacacgcccactctacgaccatcagcggacgcgaggctgnggagtgaggtctgtacttttacgtgtcgaggcggtagggacagcgacacgtgccggtggtcgggacgggggaccaggcgtacgaccgtccgtcggcacgacccgaaggcctccggccccctcggtccacgttctcccg

SEQ ID NO: 424343 - DNA, 524 bp, Homo sapiens
  misc_feature: GZ8MTXP02I3VTR.51.27.C05.1.454.CMB.2.raw
  modified_base (413)..(413): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccaacaccaccaggacaaacgcccccaaactcatgatttatgatgtcagtgactcggccctcgtaggggtttcaatcgcttctctgctcaacgtccgcaacaccggcctccctgaccatctcgtcgggcctccgaggcccgaggacgnggctgattatactgccacctcatatacaagcagacaaagaagttgggtgtcggcggacggacaagctgaccgtcgacgtcacgaaccgaggctcgcccctcggctactccg

SEQ ID NO: 424344 - DNA, 516 bp, Homo sapiens
  misc_feature: GZ8MTXP02F0S8O.51.27.C05.1.454.CMB.2.raw
  modified_base (305)..(305): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccacccaggcaaacgcccccaaatcatgatttangatgtcagtgatcggccctcgaggggtttcaatcgccttctctggctcaagttccggcaacacggcctcctgaccatctctgggctcaggccgaggacgaggctagattatactgcacctcatatacaagcagacaacaagttggtagttcggcggaaggaccaaaggctgaccgtctaacggcagcccaaggctcgcccctggccacgtc

SEQ ID NO: 424345 - DNA, 542 bp, Homo sapiens
  misc_feature: GZ8MTXP02HLQ7W.51.27.C05.1.454.CMB.2.raw
  modified_base (227)..(227): a, c, t, g, unknown or other
  modified_base (252)..(252): a, c, t, g, unknown or other
  modified_base (362)..(362): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtggttataattntgtctctggtaccaacaccacccaggcaaacgcccccaaactcatgatttatgatgtcagtgatcggccctgaggggtttcaatcgcttctctgctcaagtccggcaacnccggcctccctgacccatcctctcgggcctccgaggcccgaggacgagctgattatactgcactcatactacaagcaagcaaactaagttgggtgttcggacggaggggaccaagctaggaccgtcgtacggtcacgccaaggccgtacgcccccgtcgtaccacttcgtcgttcccccg

SEQ ID NO: 424346 - DNA, 521 bp, Homo sapiens
  misc_feature: GZ8MTXP02JLMIJ.51.27.C05.1.454.CMB.2.raw
  modified_base (324)..(324): a, c, t, g, unknown or other
  modified_base (344)..(344): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttatgatgtcagtgatcggcctnaggggtttcaatcgccttcnctgctcaagtccgcaacacggcctccctgaccatctctgggctccgaggccgaggacaggctgattatactgcactcatatacaaagcagacaaacaattgggtagttcggcggaagggacccaaaggctggaaccgttccaggtccagcccgaaggcctcgccccctggcacgtcc

SEQ ID NO: 424347 - DNA, 690 bp, Homo sapiens
  misc_feature: GZ8MTXP02JG724.51.27.C05.1.454.CMB.2.raw
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagagccaggccagtcccctgtcgtggtcatctatcaagacaccaagcggccctcgagggactccctgacgcgtattcccctcgtcggacctaccaactccgtaggggaacccacgaacggcccaaccttcctacgaaccccaagtaccgaacgggcccggggaacgccgaagggtcctggtagggagttgggaaggtcgttacggtaacgtttttaccgtggtccgtaaggggccggttacgggggacacgggaccgaacgtaccgttcggtcccgggttgggttcccgggggaccggggggtaaccctaaacgggcccggttacggaccccgggtttcccgtccggggttaccgaaccgggcccccgaaaggggccccgttacccgggcccccccgttaccggggtaccctacccgtttcccgtttcccccgg

SEQ ID NO: 424348 - DNA, 535 bp, Homo sapiens
  misc_feature: GZ8MTXP02IQD1B.51.27.C05.1.454.CMB.2.raw
  modified_base (395)..(395): a, c, t, g, unknown or other
  modified_base (421)..(421): a, c, t, g, unknown or other
  modified_base (435)..(435): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgtttcctggtatcaacagaagccaggccagtcccctgtcgtgtcatctatcaagacacaagccggccctcaggactcccctgacgcgtattcctctcggcctccgaaactccgtagggaaccacagcccactctacgaccatcgagtgggacgngaggctgtgatgaggctgtactttcngtcaggcgtggacngcgacacgtgccgtggtcgggcgggggaccaggctcggacccgtccgtcggaccacggccccgaaggcccgttcgcccccgtcggtccacgtcgttcccg

SEQ ID NO: 424349 - DNA, 551 bp, Homo sapiens
  misc_feature: GZ8MTXP02I9Q0J.51.27.C05.1.454.CMB.2.raw
  modified_base (345)..(345): a, c, t, g, unknown or other
  modified_base (360)..(360): a, c, t, g, unknown or other
  modified_base (367)..(367): a, c, t, g, unknown or other
  modified_base (370)..(370): a, c, t, g, unknown or other
  modified_base (373)..(373): a, c, t, g, unknown or other
  modified_base (381)..(381): a, c, t, g, unknown or other
  modified_base (391)..(391): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctgtaccaacaccacccaggaccaaacgcccccaaactcaatgatttatgatgtcagtgactcgcctgaggggtttcaatcgcttcnctgctcagtcgcacncgctccnacntcntggctcgnggccaggacnggctgtattatactgccacctctatactaacgaagcaaggactaaactaaggttcggggtcgttacgggacgggaacggggaccaggccgtacggacccgttcccgtaagggtccaacggcccgtaaacggcctccggtcccccgtcggtcctacctccg

SEQ ID NO: 424350 - DNA, 557 bp, Homo sapiens
  misc_feature: GZ8MTXP02I8EDO.51.27.C05.1.454.CMB.2.raw
  modified_base (224)..(224): a, c, t, g, unknown or other
  modified_base (238)..(238): a, c, t, g, unknown or other
  modified_base (248)..(248): a, c, t, g, unknown or other
  modified_base (295)..(295): a, c, t, g, unknown or other
  modified_base (304)..(304): a, c, t, g, unknown or other
  modified_base (349)..(349): a, c, t, g, unknown or other
tcagcgatcgtatacacgaccggtgctcgatttagacgcgatcgaagggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataattngtctctggtaccaacaccaccaggcaaagccccaaatcatgatttangatgcagtnatcgccctgagggtttcaatcgcttctctgctcagtccggcaacncggcctcctagaccatcctacgtcgggcctccgaggtcccgagggaccgagggtctggaactttacgttacgtgacctaccgtcaattactacaagcaagacaaacgaagttgggtgttacggacgggtaggaccaaggctacggaccgtcgtaggtccacgtcccaaggtctccggaccccgtggtaccacgttcgtcgttaccccc

SEQ ID NO: 424351 - DNA, 505 bp, Homo sapiens
  misc_feature: GZ8MTXP02FMIC3.51.27.C05.1.454.CMB.2.raw
  modified_base (301)..(301): a, c, t, g, unknown or other
  modified_base (361)..(361): a, c, t, g, unknown or other
  modified_base (415)..(416): a, c, t, g, unknown or other
  modified_base (421)..(421): a, c, t, g, unknown or other
  modified_base (425)..(425): a, c, t, g, unknown or other
  modified_base (429)..(429): a, c, t, g, unknown or other
  modified_base (432)..(432): a, c, t, g, unknown or other
  modified_base (437)..(437): a, c, t, g, unknown or other
  modified_base (461)..(461): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggcaaagcccccaaatcatgatttangatgtcagtgatcggccctcaggggtttcaatcgcttctcctggctcaagtccggcaacncggcctcctgacccatctctgggctccaggcccgaggacgagctgattattacnncactnatanacancanacaanagttggtgtcggacgaggacagcncgacgtcgacgtcacgccagcgtcgccccgtcgcactctctccc

SEQ ID NO: 424352 - DNA, 553 bp, Homo sapiens
  misc_feature: GZ8MTXP02HODB1.51.27.C05.1.454.CMB.2.raw
  modified_base (368)..(368): a, c, t, g, unknown or other
  modified_base (426)..(426): a, c, t, g, unknown or other
  modified_base (537)..(537): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccaccaggcaaacgcccccaaatcatgatttatgatgtcagtgatcggccctcgaggggttttcgaaattcgcttctccgtggctcaagtccggacaacnccggcctcctgaccatctctcgggctccgacggccgaggaccgagctagattattacngcactcatatacaagcagcaaacgaagttgggtacgttacggcgggaagggaccaagtcgtacgaccgtcgtaggtccacgacccgaaggtccgtcgcccccgtcggtacnccgtcctcgtcccccg

SEQ ID NO: 424353 - DNA, 515 bp, Homo sapiens
  misc_feature: GZ8MTXP02JO40F.51.27.C05.1.454.CMB.2.raw
  modified_base (425)..(425): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctggtaccaacaccacccaggcaaacgcccccaaatcatgatttatgatgtcagtgatcggcctcaggggtttcaatcgccttctctgctccaagtccggcaacacggcctccctgaccatctctgggcctccgaggccgaggacgaggctgattatactgcacctnatatacaagcagacaacattgggtgtcggcggacggaccaagcctgaccgtctaggtcagcccgaaggcctcgccccctggtccactccg

SEQ ID NO: 424354 - DNA, 557 bp, Homo sapiens
  misc_feature: GZ8MTXP02GQMMO.51.27.C05.1.454.CMB.2.raw
  modified_base (305)..(305): a, c, t, g, unknown or other
  modified_base (343)..(343): a, c, t, g, unknown or other
  modified_base (365)..(365): a, c, t, g, unknown or other
  modified_base (418)..(418): a, c, t, g, unknown or other
tcagcgatcgtatacacgaccggtgctcgatttagacgcgatcgaagggtttgggggctggggtctcaggaggcagcgatctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccacccaggcaaacgcccccaaatcatgatttangatgtcagtgatcggcctgaggggtttcatcgccttcnctggctcaagtccggctaaacncggcctccctgaccatctcgtggcctcgaggcgaggacgaggctgattatacngcactcatactacaagcagacaaacgtaagttgggtagttcgggacggtagggacctaaggccgttacggaacccgttccgtaaggtccacggcccccaaagggccctacggtcccccctagggtcccacgtttccccg

SEQ ID NO: 424355 - DNA, 581 bp, Homo sapiens
  misc_feature: GZ8MTXP02HXGH1.51.27.C05.1.454.CMB.2.raw
  modified_base (211)..(211): a, c, t, g, unknown or other
  modified_base (226)..(226): a, c, t, g, unknown or other
  modified_base (300)..(300): a, c, t, g, unknown or other
  modified_base (356)..(356): a, c, t, g, unknown or other
  modified_base (369)..(369): a, c, t, g, unknown or other
  modified_base (372)..(372): a, c, t, g, unknown or other
  modified_base (410)..(410): a, c, t, g, unknown or other
  modified_base (422)..(422): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcncctgcactggaaccngcagtgacgttggtgttataattatgtctctggtaccaacaccaccaggacaaacgccccaaatcatgatttangatgtcagtgatcggcctgtaggggtttcaatcgcttctctgctcaagtcgcaacncgcctcctgaccntcnctgggctcgaggccgaggacgagctagtattacgtacncgacaacccttntaatactaacgaagacaacgacaaacgtaggttgggtacggttccggggacggacggaacctaacggtccgtacggtacccgttacggtacggtaccgaaccgtaccgaacggtcccgtccgtaccccgtacggtacctaccgttccgttaccgtcccc

SEQ ID NO: 424356 - DNA, 630 bp, Homo sapiens
  misc_feature: GZ8MTXP02IRBBS.51.27.C05.1.454.CMB.2.raw
  modified_base (359)..(359): a, c, t, g, unknown or other
  modified_base (371)..(371): a, c, t, g, unknown or other
  modified_base (374)..(374): a, c, t, g, unknown or other
  modified_base (410)..(410): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccaccaggcaaacgcccccaaactcatgatttatgatgtcaagtgatcggccctgtagggttcaatcgcttctctgctcaagtccgcaacncgctcctgaccntcnctcggcctcaggccgaggacgagctgtattagtacngctacctactatactacaagcaacgactaaacgtaaagtttcgggggtacgtttaccggggacggggtaaacgggtaacccgaaaacggtccgttacggggtaaccccgttacccggtaacgggttaaccgacccggtaacccgaaacgggtcccgttcccggcccccccgtttcggggtaaccctaccccggtttacctttacccggtttacccccccg

SEQ ID NO: 424357 - DNA, 527 bp, Homo sapiens
  misc_feature: GZ8MTXP02ITIR8.51.27.C05.1.454.CMB.2.raw
  modified_base (230)..(230): a, c, t, g, unknown or other
  modified_base (306)..(306): a, c, t, g, unknown or other
  modified_base (361)..(361): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctggtaccaacaccacccaggcaaacgcccccaaactcatgatttangatgtcagtgatcggcctcaggggtttcaatcgcttctctgctcaagtcgcaacncggcctccctgaccatctctgggctccgaggccgaggacgaggctgattacttactgactacctcattactacaagcacgacaacaagttgggtacgtcggcgggacggaccaagctacgaccgtccgtagtcacgcccgaaggctccgcccctcggtcacttccg

SEQ ID NO: 424358 - DNA, 546 bp, Homo sapiens
  misc_feature: GZ8MTXP02FKNQO.51.27.C05.1.454.CMB.2.raw
  modified_base (249)..(249): a, c, t, g, unknown or other
  modified_base (299)..(299): a, c, t, g, unknown or other
  modified_base (358)..(358): a, c, t, g, unknown or other
  modified_base (415)..(415): a, c, t, g, unknown or other
tcagcgatcgtatacacgaccggtgctcgatttagacgcgatcgaagggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctgtaccaacaccaccaggcaaacgcccccaaactcatgatttangatgtcagtgatcggccctgaggggtttcaatcgcttctctgctcaagtccggacaacnccggcctcctgaccatctctgggcctccgaggccgaggacgaggctagattattacngcctacctcaatataacaagcaagcaaactagtttggggtgttacgggacgggagggaaccaagtccgaggtacccgtctagggtccacgcccgaaggcctcgcccccgtcggacactcctcgttaccccc

SEQ ID NO: 424359 - DNA, 571 bp, Homo sapiens
  misc_feature: GZ8MTXP02HKTCW.51.27.C05.1.454.CMB.2.raw
  modified_base (230)..(230): a, c, t, g, unknown or other
  modified_base (303)..(303): a, c, t, g, unknown or other
  modified_base (365)..(365): a, c, t, g, unknown or other
  modified_base (375)..(375): a, c, t, g, unknown or other
  modified_base (383)..(383): a, c, t, g, unknown or other
  modified_base (406)..(406): a, c, t, g, unknown or other
  modified_base (421)..(421): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacaccaccaggcaaacgcccccaaatcatgatttangatgtcagtgatccggcctgaggggtttcaatcgccttctctgcctacaacgtccgcaaacncggcctcccngaccatcncgtggcctcgaggccgaggacgngctagtattattacngtacctacctactaataactacgaaagcaagaccaaagtaggtttggggtaggttcgggacgggaacgggaaccaaaggccgttacggaacccgttcgtaacggccacgaacccgtaggccctaccgccccgtacggacctaccttcccg

SEQ ID NO: 424360 - DNA, 548 bp, Homo sapiens
  misc_feature: GZ8MTXP02F3IHF.51.27.C05.1.454.CMB.2.raw
  modified_base (359)..(359): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctggtaccaacaccaccaggcaaagcccccaaatcatgatttatgatgtcagtgatcggccctgaggggtttcaatcgcttctctgctcaagtccgcaacncggcctccctgaccatctctggcctccgacggccgaggaccgaggctgattatactgcctacctcatatacaagcagacaaactaagttggggagttcgggacggacgggaacccaaaggtcctaggacccgtacctaaggtccgaacgccccgaaaggccctacggcccccctggtcccacttccccg

SEQ ID NO: 424361 - DNA, 542 bp, Homo sapiens
  misc_feature: GZ8MTXP02FZ2ZQ.51.27.C05.1.454.CMB.2.raw
  modified_base (226)..(226): a, c, t, g, unknown or other
  modified_base (250)..(250): a, c, t, g, unknown or other
  modified_base (299)..(299): a, c, t, g, unknown or other
  modified_base (338)..(338): a, c, t, g, unknown or other
  modified_base (358)..(358): a, c, t, g, unknown or other
  modified_base (367)..(367): a, c, t, g, unknown or other
  modified_base (415)..(415): a, c, t, g, unknown or other
  modified_base (423)..(423): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattntgtctctgtaccaacaccaccaggcaaacgcccccaaatcatgatttangatgtcagtgatcggccctgaggggtttcaatcgcttcnctgcctcaagtccgacaacncggcctccngaccatctcgtcgggcctccgacggcgaggacgaggctgtattatacngctacctnaatactacaagacaagacaaacgtagttcgggtgttcgggacggacggacaacgctaggaccgtcgacggtcacgcctaaggccgtccgccccgtcggtcctactccgtcgttcccccg

SEQ ID NO: 424362 - DNA, 598 bp, Homo sapiens
  misc_feature: GZ8MTXP02I9LHH.51.27.C05.1.454.CMB.2.raw
  modified_base (229)..(229): a, c, t, g, unknown or other
  modified_base (252)..(252): a, c, t, g, unknown or other
  modified_base (259)..(259): a, c, t, g, unknown or other
  modified_base (298)..(298): a, c, t, g, unknown or other
  modified_base (308)..(308): a, c, t, g, unknown or other
  modified_base (379)..(379): a, c, t, g, unknown or other
  modified_base (406)..(406): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttatattntgtctcngtacacaccaccagcaaaccgccccaaatcatgatttangatgtcagtnacgtccgcctgtaggggtttcatccgcttctctaggcctacgacgtccgcaacgccggtcctccctgaccntcgtcgtggacctcgaggccgagacgnggtctagtattactacgtacgacctacctactaatacgtaacaaacgacctagacgaaactaaggttgggttaacgtcggggacggaacggggacaaacggtccgttaccggaaccggttaccgtacgggtaccaccggaacccgtaacgggtcccttacccggcccccgttacggtcctacctttccccgg

SEQ ID NO: 424363 - DNA, 539 bp, Homo sapiens
  misc_feature: GZ8MTXP02G9VUF.51.27.C05.1.454.CMB.2.raw
  modified_base (230)..(230): a, c, t, g, unknown or other
  modified_base (255)..(255): a, c, t, g, unknown or other
  modified_base (300)..(300): a, c, t, g, unknown or other
  modified_base (437)..(437): a, c, t, g, unknown or other
  modified_base (517)..(517): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatntctctgtaccaacaccaccagcaaacgccccaatcatgattttangatgtcagtgtactcggcctcgtaggggtttcaattcgccttctctggctcgagtccgcaacgccgcctcctgaccactctcgtggcctcgaggcgaggacgaggctagtattatactgcctactcatactacgaanaccagaccaaagtacggttgggtacgtcgggacggaacggacctaagcgtagacccgttcgacgtccagcccgaggtccnccgtccccgtcgtacacttccg

SEQ ID NO: 424364 - DNA, 564 bp, Homo sapiens
  misc_feature: GZ8MTXP02GABLK.51.27.C05.1.454.CMB.2.raw
  modified_base (446)..(446): a, c, t, g, unknown or other
  modified_base (556)..(556): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatatatgtctctgtaccaacaccacccaggacaaacgcccccaaactcatgatttatgatgtcagtgatcggcccttcgtaggggtttcaatcgccttctcgtgctcaacgtccggcaacgaccggtccctcctcgacctactctcgtgggcctccgacgggccgaggacgaggtctagtattacttactgcctacctnatatacaagcagacaaactaagttgggtacgttcgggacggacgggaaccaagccgtacgaccgtccttaacggccaacgcccgaacggcctccgcccccgtcggtaccncgttcccg

SEQ ID NO: 424365 - DNA, 696 bp, Homo sapiens
  misc_feature: GZ8MTXP02HKV13.51.27.C05.1.454.CMB.2.raw
  modified_base (229)..(229): a, c, t, g, unknown or other
  modified_base (299)..(299): a, c, t, g, unknown or other
  modified_base (588)..(588): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacgagggtcctgggcccagtctgccctgactcagcctgcctccgtgtcgtggtctcctggacagtcgatcaccatctcctgcactgaacngcagtgtagttggtgttatatatgtctctgaccaacaccaccagacaacgaccccaactcatgtatttangtatgtactaggtcgtacgtcccggtcccgttacggtacggggtttacgaaacttccggtccctttccgttccgtcggtaccccttaacccgtaaaccggttcccccggaccgtaaaccccggtaacccgggtcccccttacccccgtaccggtaaacccctacgtttcccgtaccggtccggggtaccccttacccgggaaccgggggaccccggaacggggtaaccggtacgggtccttaggtaactttaacgttccgtacgtaccctactactaataactacgaancgaacgactaaacgtaggttcgggtacggtcgggaacggtacggaccagtccgtacgtaccgtcgtacgcaacgccgagtccgtccgcccgtacgtactccgttcccg

SEQ ID NO: 424366 - DNA, 533 bp, Homo sapiens
  misc_feature: GZ8MTXP02JYDXZ.51.27.C05.1.454.CMB.2.raw
  modified_base (362)..(362): a, c, t, g, unknown or other
  modified_base (421)..(421): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctcctggtaccaacaccacccaggcaaacgcccccaaactcatgatttatgatgtcagtgatcggccctcgaggggtttcaatcgcttctcctgctcaagtccgcaacncggcctcctgaccatctctgggctccgaggccgaggacgagctgattatactgcacctnatatacaagcagacaactaagttgggtgttcggcggaggaccaagctagacccgtctacggtcgacgcccgaaggcctacggccccctcggtaccacctcgtcgttaccccc

SEQ ID NO: 424367 - DNA, 564 bp, Homo sapiens
  misc_feature: GZ8MTXP02H311T.51.27.C05.1.454.CMB.2.raw
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctctggggataaattgcgcgatagatatgttcctggtatcaacagaagccaggccagtcccctgtcgtggtcatctatcaagacacaagcgccctcaggactccctgacgcgtattcctctcggctccaactcgtacgggacacacgcccactctacgaccatcagcggacgcgaggctgtggatggagtctgtacttttacgtgttcgagggtcgtgggacaggcgactacgcggtccggtggtcggggccgggggtaccaacggcgtcggtaacccggtccgttccgggacaccggacccgaacgggccctaccggcccccgtcggtaccctccgttccgtttccccgg

SEQ ID NO: 424368 - DNA, 604 bp, Homo sapiens
  misc_feature: GZ8MTXP02G94YQ.51.27.C05.1.454.CMB.2.raw
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtcccccaggacagacagccagcgtcacctgctcgtgggataaattgcgcgatagatattgtttcctggtatcaaacagaagccaggcccacgtcccctgtccgtggtcatctatcaagacaccaagccggccctcgagggactcccctgagcgtattcccctctcggccttaccaaacgttcctacggggaaccaccgacgccctaactctacgacccagtccgaggccgggacgcgacgggcgtggtggactggacgtctagttactttacgtgtacgtaggtcggtagggacaggaccgacacgtcggtccggttgggtcgggaccgggggtacaacggtccgtacggacccgtccgtccggtaccgacgacccgaacggtcctacccgccccgtcggtcctaccgtccgtttccccgg

SEQ ID NO: 424369 - DNA, 704 bp, Homo sapiens
  misc_feature: GZ8MTXP02JM9OF.51.27.C05.1.454.CMB.2.raw
  modified_base (337)..(337): a, c, t, g, unknown or other
  modified_base (389)..(389): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatcatcaagacaccaagcggaccctcgagggactccctgacgcgtattcccnctggcctcctaactccgtaggggaccacgaacgcccaactcctcgaccctanccgaaggccgggaacgcgaagggcctggtggaagttgggaacgggtccttagggtaccctttttaaagtcggttacgaacgggggtccggttagggggaacctaaacggcccgggtaaacccgtacgggttccgggtcccggggtttacgggggttacccggggggaaccgggggaaacccgtaaacgggtcccggtacccgggtaaccccgggttcccggtacccgggtacccgaacccggtacccggtaaccgggtccccgtaccccgggtacccccgtacggttacccctacccgtttaccccgtttccccg

SEQ ID NO: 424370 - DNA, 721 bp, Homo sapiens
  misc_feature: GZ8MTXP02GBDFC.51.27.C05.1.454.CMB.2.raw
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctgtaccaacaccaccagacaaacgcccccaaactcatgtattatgatgtcagtgatccggcctgtaggggtttcaatcgtccttcgtctcggtcctaccgtaacggtcccggacaaaccgacccgggtccctaccccgttcgaaccctattcccgtccgttacggggcccttacccggaacggggccccggaaaggggaacccgggagggtaccgttaaggtaacctttaaacttaaccgttcggtaccctaaacccttacaacgtttaaaactaaccgaaaacggcctaaacggacctaaaaaccgttaaacgggtttgggggttacggttaccggggaacggggaaacggggacccctaaaggccgttaacggacccggttaccgtaaacgggtccgaaccggaacccgtaaacgggtcccttcccggacccccgtttcgggtaccctaccgtttcccg

SEQ ID NO: 424371 - DNA, 538 bp, Homo sapiens
  misc_feature: GZ8MTXP02GXWKE.51.27.C05.1.454.CMB.2.raw
  modified_base (250)..(250): a, c, t, g, unknown or other
  modified_base (297)..(297): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctggtaccacaccaccagcaaacgccccaaatcatgatttangatgtcagtgatcggccctgagggttcatcgcttctctgctcaagtccggacaacgcgcctcctgaccatctcgtcgggcctcgacggccgaggacgagctagtattatactgactactcatactacaagcagacaacgtagttgggagttcgggacggacgggaccaaggctaggaccgtcgtacggtccacggcccaaggccgtccgtcccccgtggtcctactccgttcgttaccccc

SEQ ID NO: 424372 - DNA, 650 bp, Homo sapiens
  misc_feature: GZ8MTXP02IFWF4.51.27.C05.1.454.CMB.2.raw
  modified_base (215)..(215): a, c, t, g, unknown or other
  modified_base (230)..(230): a, c, t, g, unknown or other
  modified_base (306)..(306): a, c, t, g, unknown or other
  modified_base (406)..(406): a, c, t, g, unknown or other
  modified_base (453)..(453): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcncctgcactggaaccngcagtgacgttggtgttataattatgtctcctggtaccaacaccacccaggcaaacgcccccaaatcatgatttangatgtcagtgatcggcctgtaggggtttcaatcgccttctctggcctcaagtccgcaaccgacggccctccctgaccctatccctcgtcgggcctaccgngggaccgagggacgagggtctaggatttaagtactgtacctaccctntaacgtaataacgaagccaagacctaaacgtaaaggtttggggtacggtttacggggaccgggggtaaacggggtaaccaaacggtccgttaaccgggaaaccccggtttccgtaaacgggttcccaacggtaaccccgtaaacggggccctacccggggtacccccccttacgggttaccctaccggtttcccccg

SEQ ID NO: 424373 - DNA, 601 bp, Homo sapiens
  misc_feature: GZ8MTXP02JVMKT.51.27.C05.1.454.CMB.2.raw
  modified_base (305)..(305): a, c, t, g, unknown or other
tcagcgatcgtatacacgaccggtgctcgatttagacgcgatcgaagggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccaccaggacaaacgcccccaaatcatgtatttangatgtcagtgactccggcctacgtaggggtttcaacgtcgtccttctcgtggcctaccgaacggtccgcaaaccgaccggtcccttacccgtacgaccctacttccgtcgtcggggccctaccgacgggcccggaaggacgaggctagtattacgttacgtcgacctacctacaattaacacgaagacaacgactaaacgtagtttcggggtagtcgggacggtaacggaccaagctacggaccgtcgtacggtccacgcccgaggtcctaccgcccccgtcggtccactttcccg

SEQ ID NO: 424374 - DNA, 577 bp, Homo sapiens
  misc_feature: GZ8MTXP02G3H25.51.27.C05.1.454.CMB.2.raw
  modified_base (226)..(226): a, c, t, g, unknown or other
  modified_base (250)..(250): a, c, t, g, unknown or other
  modified_base (435)..(435): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattntgtctctggtaccaacaccaccaggcaaacgcccccaaactcatagatttatgatgtcagtgatcggccctcgaggggtttcaatcgcttctccgtgcctcaagtccggacaacgccggcctccctcgacctatcctctcgggcctccgaggccgaggacgagctgattacttactgactacctnaatactacaagacagacaaacgtaagttggggtagttccggggacggaacggggaccaaacggtcttacggacccgtacgtaacggtcaacgacccgaaggccgtccgacccccgtcggtcctactccgtccgtttaccccc

SEQ ID NO: 424375 - DNA, 553 bp, Homo sapiens
  misc_feature: GZ8MTXP02FO6BD.51.27.C05.1.454.CMB.2.raw
  modified_base (397)..(397): a, c, t, g, unknown or other
  modified_base (417)..(417): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttctggtatcaacagaagccaggccagtccccctgtcgtggtcatctatcaagacaccaagccggccctgagggactcccctgagcgtattcctctggctccaactcgtagggaccacacgccactctgaccatcgaggccggacgcgaggctgnggatgaggctgtactttacngtcagggcgtgggacagcgacacgtggccggttggttccgggggcgggggtaaccaaggcgtacgacccgttccgtccggtccgacgcccgaacggccctccggccccccgttcggtccaccgttcctttccccgg

SEQ ID NO: 424376 - DNA, 634 bp, Homo sapiens
  misc_feature: GZ8MTXP02G7YHU.51.27.C05.1.454.CMB.2.raw
  modified_base (408)..(408): a, c, t, g, unknown or other
  modified_base (452)..(452): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtggggataaattgcgcgatagatatcgtttcctggtatcaacagaacgccaggccacgtcccctgtcgtggtcatctatacaagacaccgagccgcctcgaggactcccgtagacgcgtattccctcgtcggcctaccaacgttccgacgggaccacgacgccctactcgtacgaccatccgaggtcggacncgaggcttaggagagtggacggtcttacggttaaccttttcggnggtacggagggtcgggtacgggacacggaccgacgtcggtcgggtccggggttacgggggtaccgggggaccgggtaaccacggtccggtaccggtacccggtccggtaccggaccgaccggtacccggaacggtccccgtccccggtccccgttacgtacccttacccgttcccgtccccg

SEQ ID NO: 424377 - DNA, 585 bp, Homo sapiens
  misc_feature: GZ8MTXP02GWSC6.51.27.C05.1.454.CMB.2.raw
  modified_base (230)..(230): a, c, t, g, unknown or other
  modified_base (306)..(306): a, c, t, g, unknown or other
  modified_base (372)..(372): a, c, t, g, unknown or other
  modified_base (377)..(377): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctggtaccaacaccaccaggacaaacgcccccaaactcatgatttangatgcagtgatcggccctcgtaggggtttcatcgccttctctgctccagtccgcacacgcctcccngaccntctcgtcgggcctcgacggcccgaggaccgaggctgattactactgcctacctcattaactacaagcaacgacaaagtaacgtttggggtacgttcgggacgggaacgggaccaaaggtccgtacggacccggttaccgtaacggggtacccaacgccccgaaacggtccctacccggtcccccgtccggtaccgtacccgtttcccg

SEQ ID NO: 424378 - DNA, 621 bp, Homo sapiens
  misc_feature: GZ8MTXP02I6UMH.51.27.C05.1.454.CMB.2.raw
  modified_base (227)..(227): a, c, t, g, unknown or other
  modified_base (446)..(446): a, c, t, g, unknown or other
  modified_base (473)..(473): a, c, t, g, unknown or other
  modified_base (494)..(494): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttataattatgtctctggtaccaacaccaccagacaaacgcccccaaactcatgatttactgatgtcagtgatccggcccgtcgtacggggtttcgaacttccggtactttctacccgtcgtccgtaccaacgtccggaccaacgcccggggccctcccgtacgacctaactctcgtcgggccctcgacggccgaaggaccgngtactagtattattacgtagctacctntaaactacttaacgatacganaactaacgtaagttcgggtaggttccgggaggtacgggaacctacggactacggaccgtacggtacgtacgaaccggtccaagggtccctacgccccgtcggtacctccgtcttcccgttacccccg

SEQ ID NO: 424379 - DNA, 671 bp, Homo sapiens
  misc_feature: GZ8MTXP02HLHBL.51.27.C05.1.454.CMB.2.raw
  modified_base (301)..(301): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccaccagcaaacgcccccaaatcatgatttangatgtcagtgatccggtcctcgtaggggtttcaattcgccttctcgtggctcaacgtccgcaaacgcggccctcctgacctactcctcgtcgggtcctaccgagggacccgagggacgagggtctgtactttataccgtcgtacctaccttactaagtactaacgaacgcaacgactaaacgtaaggtttcgggggttacgttaccgggggaccggggtaaacggggaacccgtaaacggtcccgttaacggtacccgggttacccgttaacgggggttacccaaacccggggtaacccccgaaacgggggtcccccttaccccggtaccccccccggttacggggttcccctaacccgttttcccccgg

SEQ ID NO: 424380 - DNA, 620 bp, Homo sapiens
  misc_feature: GZ8MTXP02F4BFM.51.27.C05.1.454.CMB.2.raw
  modified_base (230)..(230): a, c, t, g, unknown or other
  modified_base (303)..(303): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctgtaccaacaccaccagacaaacgacccccaatcatgtatttangatgtacagtgactccggcccttagtaggggttcaacgtcgtccttctcgtcgtacctaccgaacggtccgccaaccgaccgtccctcccgcgaccactccgtcgtcggcctacccggacggccggaagggtacggacgtacgtaggtaactttacgtactacgaccctaacctactaataactaacgaagaccaagaacctaaagttaggttgggtcggtacgggacgggtaacggaccgaagtccgtacggtaccgtacgtacggccaccggaacccgtacggcctcccggccccttacggacctacgttccccg

SEQ ID NO: 424381 - DNA, 618 bp, Homo sapiens
  misc_feature: GZ8MTXP02H5BNR.51.27.C05.1.454.CMB.2.raw
  modified_base (471)..(471): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctgtaccaacaccacccaggacaaacgcccccaaatccatgatttatgatgtcagtgatcggccctgtaggggtttcaaatccgcctttcgtctggcctaccgtaacggtcccggcaaaccaccgggtcccctccccgtgaaccacttcctccgtggggcccttcccgagggacccggaggtaccggacgggcttaggtaactttattacgngtcccaacttccaattaactaccaaagcccagactaaactaaaggtttcggggttagttacggggcggaacgggacccaaggtcgtacgacccggtctacggtcacggaaccgaacggctccgacccccgtggtaccacgtttcccg

SEQ ID NO: 424382 - DNA, 561 bp, Homo sapiens
  misc_feature: GZ8MTXP02G11GG.51.27.C05.1.454.CMB.2.raw
  modified_base (226)..(226): a, c, t, g, unknown or other
  modified_base (251)..(251): a, c, t, g, unknown or other
  modified_base (302)..(302): a, c, t, g, unknown or other
  modified_base (341)..(341): a, c, t, g, unknown or other
  modified_base (360)..(360): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataattntgtctctggtaccaacaccaccaggcaaacgcccccaaactcatgatttangatgtcagtgatcggccctgaggggtttcaatcgcttcncctgctcaagtccgcaacnccggcctcctgaccatctcgtcgggctccgaggccgaggacgaggctagattatactgcactcatactacagcaagacaaataagttcgggtaggttccggcgggagggaccaaacggctaggacccgtacgaaggtccgaccgacccgaagggtcctccggcccccgtaggtccctaccgttccgttaccgttccccccg

SEQ ID NO: 424383 - DNA, 556 bp, Homo sapiens
  misc_feature: GZ8MTXP02G42RJ.51.27.C05.1.454.CMB.2.raw
  modified_base (304)..(304): a, c, t, g, unknown or other
  modified_base (416)..(416): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccacccaggcaaagcccccaaatcatgatttangatgtcagtgatcggcctcgaggggtttcaatcgcttctctgctcaagtccgcaacgacggcctccctgaccatctctgggcctccaggccgaggacgaggctgattatacngacacctcatatacaaagcaagacaaacaagttgggtacgttcgggacggaacgggacctaaaggcgtacgaacccgttccgtaacggtccaacgaacccgaaacgggcctccgcccccgttcggtcctacgtttccccg

SEQ ID NO: 424384 - DNA, 601 bp, Homo sapiens
  misc_feature: GZ8MTXP02HWFQC.51.27.C05.1.454.CMB.2.raw
  modified_base (306)..(306): a, c, t, g, unknown or other
  modified_base (449)..(449): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggacaaacgcccccaaatcatgtatttangatgtcagtgatcggcctcgaggggtttcaatcgtccttctcgtgtcctacgaacgtccggcaacgaccggcccttccctagaccctatcctcgtcggcctccgacggccgaggacgaggctagatttatactgacctacctntaactataacaagcaagactaaacgtaaggtttcggggtcgttacggggacgggaacgggtaccaaaggtccgtacggaacccgttccgttaaggcccacggaaccccgaacggtccgtcccggcccccttacgggtccctacgtttccccg

SEQ ID NO: 424385 - DNA, 599 bp, Homo sapiens
  misc_feature: GZ8MTXP02JYCAR.51.27.C05.1.454.CMB.2.raw
  modified_base (230)..(230): a, c, t, g, unknown or other
  modified_base (302)..(302): a, c, t, g, unknown or other
  modified_base (401)..(401): a, c, t, g, unknown or other
  modified_base (478)..(478): a, c, t, g, unknown or other
  modified_base (592)..(592): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacaccaccagacaacgaccccaatcatgtatttangatgtacagtgacgtccggtcctacggtaggggtttacaagttcgtacccttctcgtggtcctacgtaacgtccggacaaccgtccggtcccttacccncgaacctgttccgtcgtcgggacctccggacgggcccggaagggacgacggtctagtaattactacgacactacctntaataactaacgaagcaacgactaaacgtaggttgggttaagtcgggacggacggaccagcgtacgacgtacgtcgacacggaaccgacgtccgtccgtccccgtcggtacccncgttccg

SEQ ID NO: 424386 - DNA, 611 bp, Homo sapiens
  misc_feature: GZ8MTXP02HICZM.51.27.C05.1.454.CMB.2.raw
  modified_base (231)..(231): a, c, t, g, unknown or other
  modified_base (298)..(298): a, c, t, g, unknown or other
  modified_base (455)..(455): a, c, t, g, unknown or other
  modified_base (484)..(484): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccngcagtgacgttggtgttatattatgtctcctgtaccaacaccacccagcaaacgcccccaaactcangatttatgatgtcagtgaacgtccggccctcgtaggggtttacgaagtccgtcctttcctcgtcggccttacccgaaacggttccggaccgaaaaccgtcccgggccccttccccctacgacccattccgtcgtgggccctcgacggccgaggacgngctagattactactgacacctacattaanacaaagcacgacaaacgtaagttcgggtaggtacgggacggaacggaaccaaggaccgtaggacccgtacgtacgtaccgacgaacccgaaggcctaccggcccccgtcggtacccacgtttccccg

SEQ ID NO: 424387 - DNA, 578 bp, Homo sapiens
  misc_feature: GZ8MTXP02HGTNE.51.27.C05.1.454.CMB.2.raw
  modified_base (250)..(250): a, c, t, g, unknown or other
  modified_base (302)..(302): a, c, t, g, unknown or other
  modified_base (344)..(344): a, c, t, g, unknown or other
  modified_base (562)..(562): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctcctggtaccaacaccaccaggacaaacgcccccaaatcatgatttangatgtcagtgatcggccctgtaggggtttcaattcgctttcnccgtgctccgaacgtccggacaacgccggccctcctgaccactctcgtgggcctccgacgggcccgagggaccgaggctgatttacgttactcgctaccctacattacaacaagctaaagccaaatagttgggtcgtccgggacggagggaaacccagtcgcgtaacccggtcgtaacggcaacggccccgaaaggccctacgtccccccgtggaccncgtcctcgttaccccc

SEQ ID NO: 424388 - DNA, 554 bp, Homo sapiens
  misc_feature: GZ8MTXP02H1RI5.51.27.C05.1.454.CMB.2.raw
  modified_base (305)..(305): a, c, t, g, unknown or other
  modified_base (363)..(363): a, c, t, g, unknown or other
  modified_base (372)..(372): a, c, t, g, unknown or other
  modified_base (380)..(380): a, c, t, g, unknown or other
  modified_base (432)..(432): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccagcagtgtacgttggtgttataattatgtctctggtaccaacaccaccaggcaaacgccccaaatcatgatttangatgtcagtgatccggcctgaggggtttcaatcgtcttctctgcctcaagtccgcacncgccctccngaccatcncgtggcctcgaggccgaggacgaggctagtattactctgccactcaatacanaagcaagaccaaagtaagtttggggtacgttcgggacggacgggaaccaaaggccgtacggaacccgttcgaggtaccaggtaaccccgaaggcctccggccccctttggaccttacttccg

SEQ ID NO: 424389 - DNA, 620 bp, Homo sapiens
  misc_feature: GZ8MTXP02JO74Z.51.27.C05.1.454.CMB.2.raw
  modified_base (306)..(306): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctggtaccaacaccacccaggcaaacgcccccaaatcatgatttangatgtcagtgatcggccctgaggggtttcaacttcgccctttcgctggcctaccgaagtccgcaaccgacggccctacccgtgacccatctcgtgggcctccgacggtaccgaagggacgacgggtctagtaatttacgttaacctggaccctaacctactaactaacttaacaaacgccaggaccaaacgtaaagtttcggggtcgttcgggaaccggggacggaaccggaagtcccgtaacgcccgttaccgtacgggtaccacggaacccgaagggtccctccggccccctacggtaccctactttccccg

SEQ ID NO: 424390 - DNA, 633 bp, Homo sapiens
  misc_feature: GZ8MTXP02IR6KB.51.27.C05.1.454.CMB.2.raw
  modified_base (230)..(230): a, c, t, g, unknown or other
  modified_base (301)..(301): a, c, t, g, unknown or other
  modified_base (433)..(433): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgaccaacaccaccagcaaacgcccccaaatcatgatttangatgtcagtgactccggccctgtaggggtttcaatcgtccttctcgtggcctcaacgtccgcaaaccgacggccctcccgagaccattcctcgtgggcctccgagggccgagacgtggctagtattactacncgacctacctataacgtaataacgaaacgcgaactaacgtaaacgtaagggtttcggggtacggttacggggaacgggaacgggaacccgtaaaggtcccgtacggtaaacccgttaccggtaacgggtacccgaccggaacccggtaacgggtcccctcccggtacccccgttacggtacccttaaccggtttcccccg

SEQ ID NO: 424391 - DNA, 572 bp, Homo sapiens
  misc_feature: GZ8MTXP02IGQHE.51.27.C05.1.454.CMB.2.raw
  modified_base (230)..(230): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctggtaccaacaccacccaggcaaaacgcccccaaaactcatgatttatgatgtcagtgatccggccctcgtagggggtttcaacgttcgtcctttctcgtggtccttcccaaaggttcccggcaaaccgaccgggccccttcccgtgaccctatccttcgtgggcctcccgaggcccgaggacgacggctagtattatctgcacctcatacgtacaagtcagcaactaagttgggtgttcgggcggtacgggacaagcgtcgaccgtcgtacgtcacgccgaacggcctcgcccccgtcggtccactttcccg

SEQ ID NO: 424392 - DNA, 730 bp, Homo sapiens
  misc_feature: GZ8MTXP02HQQ67.51.27.C05.1.454.CMB.2.raw
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcacgccaccctccgtgtccgtcgtccccaggacagacagccagcgtcacctgctcgtgggaataaagtgcgcgatagatatgttcctggtatacaacagaacgccaggccacgtcccctgtcgtgtcatctatacaaagacacaagccgcctacgaggactcccgtgacgcgtattccctcgtcggcctaccaactcgtacgggaccacgacgccacttccacgaacccacgtaccgacgggccgggaacgaccggaggccgttagggtacgggaacgttagggaacggtcgtttacggtttaaaccgtttttaccgtgggtaaccggtaggggtcgggttacgggggaaccgaggacccggaaacgtccgggttcggtccccggggtttagggggttaccccggggggaacccggggggtaaccctaaaccggggccggtacccgggtaaccccggttcccggttcccggggacccgaacccgggaccccggtaaaccgggccccgtacccccggtaccccccggttaccgggttacccctacccgtttccccggtttccccccggg

SEQ ID NO: 424393 - DNA, 655 bp, Homo sapiens
  misc_feature: GZ8MTXP02HX62F.51.27.C05.1.454.CMB.2.raw
  modified_base (303)..(303): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctctgtaccacaccaccagcaaacgcccccaaatcatgtatttangatgtcagtgatcggcctcgaggggtttcaatcgccttctctggcctcaagtccgctaacgacggtccctccgtagacctatcctcgcggtcctccgaggcccgaggacgacggtctacgtaattacgttaacgtcgaccacctactaattactaacgaaacggctaacggaacctaaacgtaaggtttacgggggtacggtttaccggggaacggggtaaacggggtaaaccccaaagggtcccgttacggtaaaccccgtttccggttaacggttacccgaacggtaacccccgaaacggggtaccctcccggttaccccccgtacgggttcccgttaccctttccccgg

SEQ ID NO: 424394 - DNA, 557 bp, Homo sapiens
  misc_feature: GZ8MTXP02GJNHG.51.27.C05.1.454.CMB.2.raw
  modified_base (231)..(231): a, c, t, g, unknown or other
  modified_base (294)..(294): a, c, t, g, unknown or other
  modified_base (433)..(433): a, c, t, g, unknown or other
  modified_base (451)..(451): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatcaccatctcctgcactggaaccngcagtgacgttggtgttataattatgtctctgtaccaacaccaccagacaaacgcccccaaancatgatttatgatgtcagtgatcgcctcgtagggttcaatcgtccttctcgtggcctaccgacgtccggcaacaccggtcctaccctgacctatctcgtcggcctccgaggccgaaggacgaggctagtattatacgtnaccactcatacaacgaancaagaccaaagtaggttgggtacgtcgggacggaacggacaagcgacgtaccgtcgtacggcaacgaacccgaaggccgtaccgcccccgtcggtacactttcccg

SEQ ID NO: 424395 - DNA, 556 bp, Homo sapiens
  misc_feature: GZ8MTXP02GRF72.51.27.C05.1.454.CMB.2.raw
  modified_base (230)..(230): a, c, t, g, unknown or other
  modified_base (314)..(314): a, c, t, g, unknown or other
  modified_base (424)..(424): a, c, t, g, unknown or other
  modified_base (440)..(440): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacacaccaggacaaacgcccccaaatcatgatttatgatgtcaggtnacgtcggccctgtacggggtttcgaatcgtccttctcgtggcctcgaacgttccggcaaccacggcctaccctcgacctactcgtcgtcggcctcgacggccgaggacgngagtgagttattacgngtcactcatatacaagcaagtacaacgtaagttgggtacgtgggacggacggacaaggcgtacgaccgtcgtacgcgacgaaccgaacgccgtcgcccccgtggacctacttcccg

SEQ ID NO: 424396 - DNA, 561 bp, Homo sapiens
  misc_feature: GZ8MTXP02F5PUO.51.27.C05.1.454.CMB.2.raw
  modified_base (357)..(357): a, c, t, g, unknown or other
  modified_base (396)..(396): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatatatgtctctgtacacaccaccaggcaaacgcccccaactcatgatttatgatgtcagtgatcggcctcgaggggttcaatcgccttctctggctccagtccgcaacncggcctcctgacatctcgtggcctcgaggccgaggacgngctagtattagtctagccactacatactacaagccaggacaaacgtaagttggggtacgttcgggacgggacgggaacctaaggacctggtaacccgtacgttacggccgaacgaacccgtaacggcccgtacccgacccccgttcgtaccgtaccgtttccccg

SEQ ID NO: 424397 - DNA, 558 bp, Homo sapiens
  misc_feature: GZ8MTXP02I6YAO.51.27.C05.1.454.CMB.2.raw
  modified_base (305)..(305): a, c, t, g, unknown or other
  modified_base (361)..(361): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattatgtctctggtaccaacaccaccaggcaaacgcccccaaactcatgatttangatgtcagtgatcggcctgaggggtttcaatcgccttctctgctcagtccgcaacncggcctccctgaccatctctcggctccgaggccgaggacgaggctagtattatactgcacctcatactacaagcagacaaactaagttgggtacgttcgggacgggtaacgggacctaaaggccgtacggacccgttaccgtaacggtccaacggcccgaaaggcctaccggcccccgttcggtcctaccgtttccg

SEQ ID NO: 424398 - DNA, 652 bp, Homo sapiens
  misc_feature: GZ8MTXP02HS27H.51.27.C05.1.454.CMB.2.raw
tcagcgatcgtatacacgaccggtgctcgatttagacgcgatcgaaggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtggttataattatgtctctgtaccaacaccaccaggacaaacgccccaaactcatagtatttatgatgtcagtgacgtccggtcccttacggtaggggtttacgaaagttccgtcttcgtcctggcctaccgaaacggtcccggaaccaaccgacccgggtcccttcccgtacgacccctatccgtcgtcggggcctccgacggccgagggacgaggtctgtaatttattactcgacctacctacaattaactaacaagacaacgactaaaacgtaaggtttgggggtacggttacgggacggggaagggaccctaacggtcgtacggaccgttacgtaacggtccgaacggcccgtaaggcccgtacccggtcccccgttacggccttaccgtccgtttaccgttcccccc

SEQ ID NO: 424399 - DNA, 745 bp, Homo sapiens
  misc_feature: GZ8MTXP02HOHGV.51.27.C05.1.454.CMB.2.raw
  modified_base (214)..(214): a, c, t, g, unknown or other
  modified_base (250)..(250): a, c, t, g, unknown or other
  modified_base (299)..(300): a, c, t, g, unknown or other
  modified_base (309)..(309): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctccctccgtgtctgggtctcctggacagtcgatcaccatctccngcactggaaccagcagtgacgttggtgttataattntgtctctggtaccaacaccaccaggcaaacgccccaaatcatgatttannatgtcagtnactcggccctgtagggtttcgaatcgtcttctcgtcggccttaccaagtccggacaaccgaccggccctcccgtacgaccctactcctcgtcgggtccctaccgacggcccgagggtacgaacgggcttaggactttattaccgtagtaccctaccttacctaattaaacttaaccgtaaagaccaacggtacctaaaaaccgttaaaggtttccgggggtaggttttaccgggggaccggggtaacgggggtaaaacccgaaaacgggtccgttacgggtaaccccggttacccgtttaacggggtacctaaacccggggacccccggtaaaacggggtaccccgtaacccccggggtaccccccccgttccggggtttacccctaaacccggtttacccccttccgggtttttaacccccccctaacccccccg

SEQ ID NO: 424400 - DNA, 678 bp, Homo sapiens
  misc_feature: GZ8MTXP02HGJAZ.51.27.C05.1.454.CMB.2.raw
  modified_base (230)..(230): a, c, t, g, unknown or other
  modified_base (253)..(253): a, c, t, g, unknown or other
  modified_base (288)..(288): a, c, t, g, unknown or other
  modified_base (298)..(298): a, c, t, g, unknown or other
  modified_base (333)..(333): a, c, t, g, unknown or other
  modified_base (380)..(380): a, c, t, g, unknown or other
  modified_base (464)..(464): a, c, t, g, unknown or other
tcagcgatcgtatacacgaccggtgctcgatttagacgcgatcgaagggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttatattntgtctctgacaacaccaccagacaacgaccccaancatgaatttngatgtcagtgactccggcctggtagggttcagtcnccttctcgtcgactccgaacgtccggacaacggaccgcccttccganacctattctccgtcggccctacgacgggacgacgggtacgacgggtctaggttaaacttaacgttcacgtacctaaacccgttntaattaaactaacaacggtaaccacggaaaccctaacggtttaagggtttccggggttacggggtacccgggaacggggtaaacgggtacccgaaacggtccggtaaaccggtcccggttaccttaacgggggtacccaacccggggtaaccgaaaccggggtcccttacccgggcccccgttaacgggtccctttaaaccgggtttccccccg

SEQ ID NO: 424401 - DNA, 604 bp, Homo sapiens
  misc_feature: GZ8MTXP02JP4S8.51.27.C05.1.454.CMB.2.raw
  modified_base (231)..(231): a, c, t, g, unknown or other
  modified_base (306)..(306): a, c, t, g, unknown or other
tcagcgatcgtatacacgaccggtgctcgatttagacgcgatcgaaggggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataattatgtctctgtaccaacaccaccagacaaacgcccccaaactcatgatttacngagtgtacagtgactcgtcctagtaggggtttacaagtcgtcctttctcgtggacctacgaacgtccggacaaaccgtaccggtccctaccccgtgaaccctacgtcctacgtcgggacctacccgacggacccggaaggacgagggtcctaggtaatttacgtactcgacctacctacataactacaagacagacctaataaggttggtagtacgggacggaacgggaccaaggtccgtacgaccgttcgtaacgccgaagcccgaaggtccgactccccgtacggacctacgtccg

SEQ ID NO: 424402 - DNA, 615 bp, Homo sapiens
  misc_feature: GZ8MTXP02IMGDQ.51.27.C05.1.454.CMB.2.raw
  modified_base (227)..(227): a, c, t, g, unknown or other
  modified_base (298)..(298): a, c, t, g, unknown or other
  modified_base (443)..(443): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctgtaccaacaccaccagacaaacgccccaaatcatgtatttngatgtcagtgacgtccggcccttcggtaggggtttacagttcgtcttctccgtcgcctacgaacgtccggaccaaacgccggtccctccgtacgacctactctccgtcggccctccgaggcccgaggacgagctagtattactcncgtctacctcaataactacaacgtcaaacgacaacgttaaggttcggggtcgttacggggacggacggtaacaacggtccgtacggtaaccgtccgtaacggaccaccggtacccgaacggtcccgtaccgtcccccggtacggtcctacccggttccttccgttccccccg

SEQ ID NO: 424403 - DNA, 657 bp, Homo sapiens
  misc_feature: GZ8MTXP02G9HA5.51.27.C05.1.454.CMB.2.raw
  modified_base (306)..(306): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacaccacccagaccaaacgcccccaaactcatgtatttangtatgtcagtcgagtccggcctcgtaggggtttacaagtcgtcctttctctcggcctaccgaaacggtccggccaaaccgtaccggcccttccctagaccctagttcctccgtcgggtccctaccgaccggggcccgaaggggaccggtacgggtactacggttaactttaacttaccgtcgacctaaccttacaattaactaacgaagactaacgactaaacgtaaggtttgggtacggttacgggacgggtacgggaaccaaaggtccgtaacggtacccgttacgtacggtccaacggaacccgtaacggtcccgtcccggaccccgtccgtaccgtacctttccccg

SEQ ID NO: 424404 - DNA, 591 bp, Homo sapiens
  misc_feature: GZ8MTXP02JPC1Z.51.27.C05.1.454.CMB.2.raw
  modified_base (379)..(379): a, c, t, g, unknown or other
  modified_base (456)..(456): a, c, t, g, unknown or other
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtgggataaattgcgcgatagatatgtttcctggtatcaacagaagccaggccagtcccctgtcgtggtcatctatcaagacacagcgcctgaggactcccgtgagcgtattccacgtgctaccaactcgtacgggacctacacgccctactcctacgacctancgaggaccgggacgcgaggcgtgcggatggaggtctacggttacttttacgtggtacgagggtcggtacggggaacnggaccgaacgtcgtcggtcccggttagggtccggggaccgggggtaccaaggccgtacggacccggtccgtaccgggtacacggacccgaaggtcccgtcccggtcccccgtcggtcctacccgtcgttccccgg

SEQ ID NO: 424405 - DNA, 589 bp, Homo sapiens
  misc_feature: GZ8MTXP02FIQNV.51.27.C05.1.454.CMB.2.raw
  modified_base (305)..(305): a, c, t, g, unknown or other
  modified_base (429)..(429): a, c, t, g, unknown or other
  modified_base (482)..(482): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctgtaccaacaccacccagacaaagcccccaaatcatgatttangatgcagtgatcggcccttcgtaggggtttcaagtccgcctttctcgtggccttaccgaagtcccgggcaaaccgaccggccctcccgtgacccatcctcgtgggcctccgaggccgaggacgngctgtattatactgacacctacatatacaagcagacctaaacagtttaggggngtttaccgggacggtaaggggacccaaaggccgttacggaccccggttacgtacgggtccacggaaccccgaaagggtcctccggccccctcggtacccacttcccg

SEQ ID NO: 424406 - DNA, 603 bp, Homo sapiens
  misc_feature: GZ8MTXP02HDMB7.51.27.C05.1.454.CMB.2.raw
  modified_base (304)..(304): a, c, t, g, unknown or other
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataatatgtctcctgtaccaacaccaccagcaaacgcccccaaactcatgtatttangatgtcagtgactcggcctgaggggtttcaatcgtccttctctcggcctccgaagttccgcgaaccacggccctcccgtacgaccactcctcgtcggcctccgacgggcgaacggacgacggctgtaacttataccgtgaccctaacctcaattagtaaccaagacctaagactaaactaaggtttggggtacgttacgggacgggtaacgggaccaaaggccttacggaacccgttcgtaacggtccgaacggtcccgaagggcccttccggacccccgttcggtaccaccgttcccg

SEQ ID NO: 424407 - DNA, 592 bp, Homo sapiens
  misc_feature: GZ8MTXP02IDOJF.51.27.C05.1.454.CMB.2.raw
  modified_base (230)..(230): a, c, t, g, unknown or other
  modified_base (255)..(255): a, c, t, g, unknown or other
  modified_base (300)..(300): a, c, t, g, unknown or other
  modified_base (397)..(397): a, c, t, g, unknown or other
  modified_base (447)..(447): a, c, t, g, unknown or other
  modified_base (454)..(454): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcactctcctcactcagggcacagggtcctgggcccagtctgccctgactcagcctgcctccgtgtctgggtctcctggacagtcgatcaccatctcctgcactggaaccngcagtgacgttggtgttataattangtctctgtacacaccaccagcaaacgccccaaatcatgtatttangatgtcagtgactcggccctcgtaggggttcaattcccgtcttctctcggctaccgagtcccggacaaacgtccggccctccctgaccctatctcgnggcctccgaggcccgaggacgaggtctgtatttactactgacctacctanaacttanaacaagacaagactaaacgtaaggttggggtacgtcgggacggtaacggaccaaagtccgttacgacccgttaccgttaacggccaaccggcccctaaacgggtccctacccggtccccccgtaggttaccctccccg

SEQ ID NO: 424408 - DNA, 634 bp, Homo sapiens
  misc_feature: GZ8MTXP02F7A8H.51.27.C05.1.454.CMB.2.raw
  modified_base (231)..(231): a, c, t, g, unknown or other
  modified_base (307)..(307): a, c, t, g, unknown or other
  modified_base (430)..(430): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccngcagtgtacggttggtggttatattatgtctctgtaccaacaccaccagacaaacgcccccaaatcatgtatttangattgtcagtgatccggccttggaggggtttacaactcgtcccttctcgtgcctcgaacgtccgacacgaccggcctcccgtcgactctctcgtggccctcgacggaccggaggacgacggtntacgtattagttactcgtaccaccctactaaatacgtaaacgaacgacgaagtaccaaacgttaaggttggggttacggttaccgggggacgggtaacggggtaaccccgagggtacccgttacggtacccggtaccgttaccgggtctaaccggaacccgtacggtccgtcccggtacccccgtcggtccctaccgtttcccg

SEQ ID NO: 424409 - DNA, 517 bp, Homo sapiens
  misc_feature: GZ8MTXP02FM8QQ.51.27.C05.1.454.CMB.2.raw
tcagcgatcgtatacacgaccggtgctcgatttagacgcgatcgaagggtttggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgccttctctggctcaagtccggcaacacggcctccctgaccatctctgggctccaggccgagacgaggctgattatactgcacctcatatacaagcagcaaacaattgggtgttcggcggagggaccaaagctgaccgtcctaggtcagcccaaggctcgccccctcggtcactccg

SEQ ID NO: 424410 - DNA, 790 bp, Homo sapiens
  misc_feature: GZ8MTXP02ILD6B.51.27.C05.1.454.CMB.2.raw
  modified_base (233)..(233): a, c, t, g, unknown or other
  modified_base (310)..(310): a, c, t, g, unknown or other
  modified_base (319)..(319): a, c, t, g, unknown or other
  modified_base (407)..(407): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacgagggtcctgggcccagtctgccctgactcagcctgcctcgtgtcgtgggtctcctggacagtcgatccaccatcctcctgcactggaaccngcagtgacgttggtagttatatatgtctcgtcgtaccaacaccaccgaggacaaacgaccccaaatcatgtatttancgtatcgtnagtcgactccggcctgtacgggttacaacgtcgtccttctcgtcgcctacgacgtccgactaaccgaccgtcccttccgacgtaaccncgttcccgtcgtccgggtacccttacccgggaacgggacccggaacggggacccggtaagggtaccgttaggtaactttaaaccgttaccggtacgacccgtaaacccgttagttaaacttaaaccgtaacggaaaacgaccgaaacggtaaacccgtaaaacggtttaaacgggttgggggtttaacggggttacccggggaaccgggggtaaaacgggaaaccccgtaaacgggtacccggtttaaaccgggtaaaccccggtttaccggttaaaccggtacccggaaaccccggtaaccccgggaaaacccgggtttccccgaaccccccgggtccccccggttaccggggttaacccttaaacccccgttttcccccgg

SEQ ID NO: 424411 - DNA, 691 bp, Homo sapiens
  misc_feature: GZ8MTXP02ILTQW.51.27.C05.1.454.CMB.2.raw
  modified_base (245)..(245): a, c, t, g, unknown or other
  modified_base (250)..(250): a, c, t, g, unknown or other
  modified_base (256)..(256): a, c, t, g, unknown or other
  modified_base (297)..(297): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaattngtctcngtaccaacaccaccagcaaacgcccccaaatcatgatttangatgtcagtgactcggccctgtaggggtttcaatcgctttctcctgctcagtccgacacgcggccctcctgacctatcgtcgtcgggcctccgacgggtcccgaagggccgtaacgggtctacggtaaactttacgttaccgtacgtacccgttaacccgtacctaaattaaccgttaaaccaaaacgggtcaaaaccggtaactaaaccgtaaaggttttcgggggtacggtttccgggggaacggggtaaacggggaacctaaaacgggtccgttaacccggggtacccgtttacccggtaaacggggttaccgaccgggaccccgtaaacggggtccctcccggttaccccccgtgggttaccctaccgttcccgttacccgtttcccccc

SEQ ID NO: 424412 - DNA, 553 bp, Homo sapiens
  misc_feature: GZ8MTXP02IQS5D.51.27.C05.1.454.CMB.2.raw
  modified_base (244)..(244): a, c, t, g, unknown or other
  modified_base (413)..(413): a, c, t, g, unknown or other
  modified_base (423)..(423): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttatattatgtctctggtaccaacaccaccaggcaaacgcccccaaactccatgatttatgatgtcagtgatcggccctcgtaggggtttcgaaatcgtccttctctggctccaagtccgcaacaccggcctccctgaccatctctgggcctcgagggccgaggacgnggctgaattntactgcctacctacattactacaacgtcagactaacgaagttgggtgttcgggcgtacgggaccaaagcgtacgaccgtaccgtaggtccacgaacccgaacggtcctcgccccctcgggtccacttccg

SEQ ID NO: 424413 - DNA, 643 bp, Homo sapiens
  misc_feature: GZ8MTXP02GL3SW.51.27.C05.1.454.CMB.2.raw
  modified_base (200)..(200): a, c, t, g, unknown or other
  modified_base (209)..(209): a, c, t, g, unknown or other
  modified_base (216)..(216): a, c, t, g, unknown or other
  modified_base (306)..(306): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtcgtggtctcctggacngtcatcacntcctccngcactggaacagctagtgagttggtagttaataatatgtctcctagtaccaacaccaccgagacaaaccgccccaaactcatgtatttangatgtacgtagtgacgtcccggtacccgtacggtacggggtttacgaaacgttccggtcctttccgttcgtcgggtccctaccgtaaacggttcccggaccgaaaccgaccggtccctaccccgtacgaacctattcccgtcgtcggcctccgaacgccgacgggacgcgctagtattaactctgacctactactaatactaacgaacacgaagaacctaaagtaaggttgggtacgtcggggacggaacggaccaaaggtccgtaacgtacccgttacgaacggccgacgtaaccgaacggtccgtaccccgccccgtcggtacctacgtttcccg

SEQ ID NO: 424414 - DNA, 645 bp, Homo sapiens
  misc_feature: GZ8MTXP02J2B43.51.27.C05.1.454.CMB.2.raw
  modified_base (267)..(267): a, c, t, g, unknown or other
  modified_base (310)..(310): a, c, t, g, unknown or other
  modified_base (356)..(356): a, c, t, g, unknown or other
tcagcgatcgtatacacgaccggtgctcgatttagacgcgatcgaagggtttgggggctggggtctcaggaggcagcgctctcgggactctccaccatggcctgggctctgctattcctcaccctcctcactcagggcacagggtcctgggcccagtctgccctgactcagcctgcctcgtgtctgggtctcctggacagtcgatcaccatcctctgcacgtggaaccagcagtgacggtttggagttaataattatagtccttcgnggtacccaacaccaccagacaacgcccccaaatcatgatttangatgtcagtgatccggacctgtaggggtttacaagtcgtccttacncgtcggacctacgaacggtccggcaacgacccggtccctccgtagaccctatcctcgtaccgggccctaccgggacgacggtacgacgggactcgtagttaacgtttacctagtaccacccttacctaatataacaacgacgacaacgtaacctaaagtacggggtttggtaccggacggggaaccgggaacgaacgacggtaccgtaccggtaccgttaccggacgttaaccgaccgaaccggaaccgtcccgtcccccgtcccgtaccggtaccttccttacccccg

SEQ ID NO: 424415 - DNA, 594 bp, Homo sapiens
  misc_feature: GZ8MTXP02FVHKB.51.27.C05.1.454.CMB.2.raw
  modified_base (229)..(229): a, c, t, g, unknown or other
  modified_base (303)..(303): a, c, t, g, unknown or other
  modified_base (431)..(431): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtgttataattatgtctctggtaccaacaccaccaggcaaacgcccccaaatcatgatttangatgtcagtgatccggcccttcgaggggtttcaatcgcttctcgtgctcaagtccgcaacgcggcctcccgtgaccatctcgtgggcctccgaggcccgaaggacgaggctagattatactgcacctnatatacgaagccaagacaaacgtaagttggggtattccggggagggtacggggaaccctaaaggtccgttacggaccccgttaccgtaacggttcccgaaaccggtcccccgaaaggtcccgtacccggccccccgttacggggttccccaacgttttccccg

SEQ ID NO: 424416 - DNA, 745 bp, Homo sapiens
  misc_feature: GZ8MTXP02HNC5B.51.27.C05.1.454.CMB.2.raw
  modified_base (251)..(251): a, c, t, g, unknown or other
  modified_base (253)..(253): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtaggttataattntntctctagtacaacaccaccaggacaaacgaccccaaactcatagtatttatgtatcgtctagtgtaacgtcggtacccgtcggtacggggtttacgaagtcgtcttcctcgtcggtcctaccgaacggtccggaaccaaccgaccgggtcccttacccctacgaccctactccgtacgtcgggacctccgacgggacccgaacgggaacggacgggtacttacggtaactttaacgttaccgtacgtacctaacccttactaaactaaacgttaacaaacgacgaaacgtaactaaaaccgttaagggtttcgggggttacggtttaccgggggacggggtaaacgggaaacccgaaacggtacccgttacgggtaaacccggttaccggttaacgggtaccgtaaccggtacccccgaaaggttccccgtacccggttacccccgttccgggtaccctaacccgttcccgttttccccggttaaccccccg

SEQ ID NO: 424417 - DNA, 590 bp, Homo sapiens
  misc_feature: GZ8MTXP02GLKKU.51.27.C05.1.454.CMB.2.raw
  modified_base (225)..(225): a, c, t, g, unknown or other
  modified_base (302)..(302): a, c, t, g, unknown or other
  modified_base (461)..(461): a, c, t, g, unknown or other
  modified_base (555)..(555): a, c, t, g, unknown or other
  modified_base (572)..(572): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactgaaccngcagtgacgttggtgttataattatgtctctgtaccaacaccaccaggacaaacgcccccaaactcactgtatttangatgtcagtgacgtccggccctgtacggggttctaatccgcttctctcgctaccgaagtcccgacaaaccgccgtccctccctacgacccatctcggtcggctccgacggccgaaggacgaggtctagtatttaactctagacctaaccgttcaattanaacagaccaagacaaagttagttgggtacggttacgggacggtaggaaccaagtctagacccgtacgtacggtacgaaccgtaccgaacggtcncccgccccgtcgtaccncgttccgtccgttccccg

SEQ ID NO: 424418 - DNA, 668 bp, Homo sapiens
  misc_feature: GZ8MTXP02IVGX5.51.27.C05.1.454.CMB.2.raw
tcagcgatcgtatacacgaccggtgctcgatttagacgcgatcgaagggtttggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagccgtcacctgctctggggataaattgcgcgatagactatgtttcctggtatcaacagagccaggccacgtcccctgtcgtgtcatctatcaagacaccaagcgcctcgaggactccccgtgacgcgtattccctcgtcgcctccaacttcgtacgggacacgacgcctacctcctacgacctagtcgaggcgggacgcgaggtcgtagtggaagttggaggtccgtagttaaccgtttttaaccgtcggttacggtacgggtaccggttacggggaacgacgggccgtaacgtaaccggttcggcccgggtttcgggtttcccgggggaccggggggttaaacccggaacggtccggttacggtaccccggttcccggtaccgggttacccgaccggtccccgtaaacgggccccgtacccggtccccccggtccggtaacccgttccgttaccgtttcccccgg

SEQ ID NO: 424419 - DNA, 600 bp, Homo sapiens
  misc_feature: GZ8MTXP02HGPZP.51.27.C05.1.454.CMB.2.raw
  modified_base (265)..(265): a, c, t, g, unknown or other
  modified_base (294)..(294): a, c, t, g, unknown or other
  modified_base (333)..(333): a, c, t, g, unknown or other
  modified_base (438)..(438): a, c, t, g, unknown or other
tcagcgatcgtatacacgaccggtgctcgatttagacgcgatcgaagggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatattatgtctctgtaccaacncaccagcaacgccccaaatcatgatttangatgtcagtgatcggccctgtagggtttcaatcgcttcncctggctaccgaagtccggacaacgccggcctccacgaccactctcgtcggcctccgaggccgagggaccgagggctggtaactttacttacgtcgtcaaccctntaactactaacgaaagacaagacaaacgttaagttcggggtacgttacgggacggaacgggacctaaacggccgtaggtacccgtacgtacggtacgaccggtacccaacgggtcccgtaccggtcccccgttcggacctccgtccgtttccgtaccccccg

SEQ ID NO: 424420 - DNA, 680 bp, Homo sapiens
  misc_feature: GZ8MTXP02GGUSV.51.27.C05.1.454.CMB.2.raw
  modified_base (231)..(231): a, c, t, g, unknown or other
  modified_base (546)..(546): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgtacggttggtgttaataattatgtctcgtggtaccaacaccaccaggacaaacgccccaaactcatgtatttatgatgtcagtgacgtccggcccttacgtaggggtttcaaacgttccggtccctttccgtccgtagggtcctacccgtaaacggttccccggaccaaaaccgcccggtccccttaccccgtacgaaccctagtcccttcggtccgggacccttacccgacggggacccggaagggaaccggacggtacctaggtaatttacgtaacgtcgtaccctacctactattaactaacgaanaccaacggacctaaaagtagttggggtacggtacgggacgggaacggacgtaaggtccgtacggtaaccgttccgtaacggtccaacggaacccgtaacggccgtcccgaccccgtcggtcctacccgttcccg

SEQ ID NO: 424421 - DNA, 595 bp, Homo sapiens
  misc_feature: GZ8MTXP02JPY7K.51.27.C05.1.454.CMB.2.raw
  modified_base (252)..(252): a, c, t, g, unknown or other
  modified_base (297)..(297): a, c, t, g, unknown or other
  modified_base (303)..(303): a, c, t, g, unknown or other
  modified_base (329)..(329): a, c, t, g, unknown or other
  modified_base (377)..(377): a, c, t, g, unknown or other
  modified_base (413)..(413): a, c, t, g, unknown or other
  modified_base (442)..(442): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgtataatntgtctctgaccacaccaccagcaaccgccccaatcatgtatttangatgangtgacgtccggcctgtacggggttanactcgtccttcgtcgtcgcctacgacgtccgacaccgaccgccctccncgacctctctcgtcgacctccgagggccgaggacgngtactgtactttactcgtacgacctactntaactactaacgacacgaacgacgtaaacgttggttcgggggttacgtccggggaggaacgggtacaacggtccgtaccggacccggtacgtacggtaccgaaccggccgtaacggtcccgtaccccgcccgttccggtactacgtttccccg

SEQ ID NO: 424422 - DNA, 744 bp, Homo sapiens
  misc_feature: GZ8MTXP02HGZ2W.51.27.C05.1.454.CMB.2.raw
  modified_base (226)..(226): a, c, t, g, unknown or other
  modified_base (251)..(251): a, c, t, g, unknown or other
  modified_base (300)..(300): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctggttctctgacagtcatcaccatctctgcactggaaccngcagtgacgttggtgttatattatntctctgtaccaacaccaccaggacaaaccgccccaaatcatgtatttangatgtctagtgacgtccggtccctaggtaggggtttacacgttcgtccccttctccgtcggtacctaccgtaacggtcccgaccgtaaaccgtcccggtcccttacccgaccgtaaccctacttcccgttccgtacggggtcccctaacccggacgggggaccggaacgggggaccgtacgggtacttacgttaaacgtttacctttaacgccgtaaccccgtacctttaacgaaactttaaacgttaaaccgaaacgttaccaaacggtaaccgaaaacgtttaaggggtttcgggggttaccgggttaccggggaaccggggaaacgggtaacctcggtaccgttaccggacccggttaccgtaacgggtccctaaccgggaacccgtaacgggtcccccgtcccggttacccccgtacggtttcccgtaccgtttccccgg

SEQ ID NO: 424423 - DNA, 558 bp, Homo sapiens
  misc_feature: GZ8MTXP02JDZIH.51.27.C05.1.454.CMB.2.raw
  modified_base (315)..(315): a, c, t, g, unknown or other
  modified_base (326)..(326): a, c, t, g, unknown or other
  modified_base (388)..(388): a, c, t, g, unknown or other
  modified_base (451)..(451): a, c, t, g, unknown or other
  modified_base (456)..(456): a, c, t, g, unknown or other
  modified_base (460)..(460): a, c, t, g, unknown or other
  modified_base (465)..(465): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctcgcctccgtgtctgggtctcctggacagtcgaatcaccatctcctgccactggaaccagcaggttgacgttggtagttataattatgtctcctaggaccaaacaccaccaggacaaacgcccccaaatcatgtatttaangtatgacagtnactcggcctcgaaggggttccaatccgtccttctcgtacgctacgaacgtccggacaaaccncggtcctccctagacctatctcgtggcctacgaggccgaagtacgcggatagattaattcacncacanatanacaanacacacaacgtagtaggtagtcggacggacggacgacgacgacgacgtacgacgacgacgaaccgacgacgtccgacccgtccgtactactcg

SEQ ID NO: 424424 - DNA, 705 bp, Homo sapiens
  misc_feature: GZ8MTXP02HX94V.51.27.C05.1.454.CMB.2.raw
  modified_base (306)..(306): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcagtgacgttggtagttataattatgtctcctgtaccacaccaccagacaaacgacccccaatcatgtatttangtatgtctagtgacgtcggtccctggtaggggtttacgatcgtccttctcgtcggcctccgaacggtcccggacaaccgaccggtccctaccccgtagaaccctattcccgtccgtcgggcccttccggacgggcccggaacgggaccgtaggccttaggtaacttttacgtttaccgcggtaccctaccttactaaagtaaccttaacgaaacgaccaaacgtaaaccgtaaagttaaacgggtttcgggggttacggttacggggaaccggggtaacgggtaaacccgaaacggttcccgtaacggttaacccggtacccgttaacggggtacccaacggtaacccggaaccggttcccgtccccggccccccgttacggtccctaccgtttccccg

SEQ ID NO: 424425 - DNA, 676 bp, Homo sapiens
  misc_feature: GZ8MTXP02I67JN.51.27.C05.1.454.CMB.2.raw
  modified_base (227)..(227): a, c, t, g, unknown or other
  modified_base (250)..(250): a, c, t, g, unknown or other
tcagcgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctctgcacgtggaaccngcagtgacgttggtgttatattntgtctctgtaccaacaccaccaggacaaacgcccccaaactcatagtatttatgtatgtacagtgactccggcccgtggtacgggtttacaattcgacttctccgtcgctacgaacgtccggaccaccgccggtccctccctacgacctactcgtcgtcgggccctccggacggcccggaacgggacgacggtcttacgtacttaacttaccgcgacctacctacgtaaacttacgaaacacggactaacgtaaccgtaaacgtaagggtttcgggtacgggttccgggaggggaaacggaccgaaacggtccgtaaccggtacccgtacgtacgggtacccgaaccggtacccgtaacggtcccgttcccggtacccccgttcgggtaccctacccgtttacccggtttccccgtttaccccccg

SEQ ID NO: 424426 - DNA, 624 bp, Homo sapiens
  misc_feature: GZ8MTXP02G3AUB.51.27.C05.1.454.CMB.2.raw
  modified_base (233)..(233): a, c, t, g, unknown or other
  modified_base (265)..(265): a, c, t, g, unknown or other
  modified_base (308)..(308): a, c, t, g, unknown or other
  modified_base (349)..(349): a, c, t, g, unknown or other
  modified_base (479)..(479): a, c, t, g, unknown or other
  modified_base (495)..(495): a, c, t, g, unknown or other
tcagcgatcgtatacacgaccggtgctcgatttagacgcgatcgaagggtttgggggctgggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacagtcgatcaccatctcctgcactggaaccngcagtgacgttggtagttataattatgtctcngtaccaacaccaccaggccaaacgcccccaaatcatgatttangatgacagtgatccggcctggtagggtttcatcgtccttcnctggctacgaacgttcccgcgtaaaccgcggtaccccttacccgtacgacctatcccgtacgtcggggaccctccgacggggccgaagggaccgtacggcttagtactttaacgtacgtagcctaacgtntaataacgtacaacgnaacgtacaaagtaacgtttggggtacggtcgggaacgggtaagacccgagacgtaccggaccgtacgttacgacgtaaccgcccgtaaggtcccgtacggtccccccgtgtaaccttccggtttccccg

SEQ ID NO: 424427 - DNA, 657 bp, Homo sapiens
  misc_feature: GZ8MTXP02FIXG3.51.27.C05.1.454.CMB.2.raw
  modified_base (295)..(295): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttatattatgtctctgtaccaacaccaccagcaaacgcccccaaactcatnatttatgatgcagtgatccgcctcgtaggggtttcatcgccttctcgtggctccaacgtcggctacgaccggtcctcctcgacatccttcgacgggtcctcccgaagggcccgaacgggacgaacgggtcttaggtatttaacgtttacgcgcccaacctcaaattaacgtaaacccaagaccacgaacctaaaacgttaaacgtttgggggttacggtttacggggaaccggggacggggaaacccaaaacgggtccgtacggtaaacccccggttccgtaacggggtaccaaccggaaccccgaaaacggggtccccttacccggtcccccccgtacgggtaccctacccgtttccccgg

SEQ ID NO: 424428 - DNA, 623 bp, Homo sapiens
  misc_feature: GZ8MTXP02FJKFK.51.27.C05.1.454.CMB.2.raw
  modified_base (354)..(354): a, c, t, g, unknown or other
  modified_base (370)..(370): a, c, t, g, unknown or other
tcagcgatcgtatacacgaccggtgctcgatttagacgcgatcgaagggtttgggggctgggggtctcaggaggcagcgctctcgggacgtctccaccatggcctgggctctgctattccctcacccctcctcactcagggcacagggtcctgggcccagtctgccctgactcagcctgcctccgtgtctgggtctcctggacagtcgatcaccatctcctgcactggaaccagcagtgacgttggtgttaatatatgtctcctggtaccaacaccacccaggacaaacgaccccccaaactcatgatttatagatgtcagtgatcggccctcgtagggttgaatcgtctctcngctcgacgtcgcaacnccgcctccctgaccatctcgtgggccctaccgacggccgaggacgaggtcagtattacttactcgaccaccgtactataactaacaagccgaagacaaacgtaagttggggtacggttccggggacgggtaacgggaacccgaaaggtcgtaccggtacccgttccggtaaacggtcccgtaaacggaacccccgtaaaagggtccccgttacccgggtcccccccgtaccggtccctaaccgtttcccccgg

SEQ ID NO: 424429 - DNA, 691 bp, Homo sapiens
  misc_feature: GZ8MTXP02FV3MX.51.27.C05.1.454.CMB.2.raw
  modified_base (214)..(214): a, c, t, g, unknown or other
  modified_base (232)..(232): a, c, t, g, unknown or other
  modified_base (312)..(312): a, c, t, g, unknown or other
  modified_base (364)..(364): a, c, t, g, unknown or other
  modified_base (528)..(528): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtaggacagtcgatcaccntctcctgcactggaaccngcagtgacgttggtagttaatattatgtctcgtggtaccaacaccacccaggaccaaacgcccccaaatcatagatttangatgtacagtgactccggtcctcggtaggggttacaacgtcgtccttccgtntcggtcctacaacggttcccgacaaaccgtcccggtccctcccgtagtacctactccgtcgtcgggacccttaccggaacgggaccggaaggggaccgacgggtcctaggttaactttacgtaccgtacgtaccctaccgttactaaactaagtaaccggaaanaccggaataaccgtaaaccgttaaagggtttcgggtaacggttccgggggaacggtaacgggaccctaaagggccttacggaacccgttcggtaaccggtccgaaccggaacccgtaacggtacccgtccccggtcccccgtacggtaccgtctttcccccgg

SEQ ID NO: 424430 - DNA, 576 bp, Homo sapiens
  misc_feature: GZ8MTXP02JOVS7.51.27.C05.1.454.CMB.2.raw
  modified_base (250)..(250): a, c, t, g, unknown or other
  modified_base (300)..(300): a, c, t, g, unknown or other
  modified_base (324)..(324): a, c, t, g, unknown or other
  modified_base (368)..(368): a, c, t, g, unknown or other
  modified_base (524)..(524): a, c, t, g, unknown or other
  modified_base (556)..(556): a, c, t, g, unknown or other
tcagcgatcgtatacacgaccggtgctcgatttagacgcgatcgaagggtttgggggggtctcaggaggcagcgctctcgggacgtctccaccatggtctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataattntgtctctggtaccacaccaccaggcaaacgcccccaaatcatgtatttangatgctagtgactcggccctacgnggggtttcaatcgcttctccctggcctcaacgtccggaccaacnccgggccctcccgtagaccctagtccttcgttgggccttccgaacgggccgaggcgaggtctaggattactactcgacactcatatacagtcagacaataagttggtacgttcgggacggaggacctaacgctcgtacccgtcgttaacggtaccncgacccaggtccctcggccccctacggtaccncgttccgtcgtttacccccg

SEQ ID NO: 424431 - DNA, 553 bp, Homo sapiens
  misc_feature: GZ8MTXP02FJ4KM.51.27.C05.1.454.CMB.2.raw
  modified_base (201)..(201): a, c, t, g, unknown or other
  modified_base (230)..(230): a, c, t, g, unknown or other
  modified_base (301)..(301): a, c, t, g, unknown or other
  modified_base (395)..(395): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccnggcagtgagttggtgttataatatgtctctgtacaacaccaccaggacaaacgccccaaatcatgatttangatgtacagtgagtccggcctgtaggggttcaatcgtcttctcaggctcgaacggtccggcaaacgcggcctccagacactctcgtgggtcccncgacggcgacgacgagtctagtattactactacgactacctcaacgtactaacaagactagaactaagtacggttcgggtaggtacggacggaacgacgtagctacgtaccgtacgtacgacaccgccgacgttccgtccgcccgtcgtcctactccg

SEQ ID NO: 424432 - DNA, 700 bp, Homo sapiens
  misc_feature: GZ8MTXP02I94M4.51.27.C05.1.454.CMB.2.raw
  modified_base (219)..(219): a, c, t, g, unknown or other
  modified_base (225)..(225): a, c, t, g, unknown or other
  modified_base (248)..(248): a, c, t, g, unknown or other
  modified_base (298)..(298): a, c, t, g, unknown or other
tcagcgatcgtatacacgaccggtgctcgatttagacgcgatcgaagggtttgggggctggggtctcaggaggcagcgctctcgggactctccaccatggcctgggctctgctattcctcaccctcctcactcagggcacagggtcctgggcccagtctgtcctgactcagcctgcctccgtgtctggtctcctggacagtcatcaccatctctgcacnggaacngcagtgacgttggagttataatntgtctcgtgtaccaacaccaccgagacaaacgccccaatcatgtatttangatgtcagtgacgtccggtccttacggtacgggtttcgaacgttccgtcccttcgtcgtcggtccttacgtaaccggttccgaccgtaaccgacccggtccctacccctacgtaccctacgtcccgttacggtcggtcccgttacccggaacgggacccgggaacgggaacggtaccggttacgtacggttaactttaacgttactacgtaacctaccttaccgaagttaactaacgaacgtacaacggtaactaacggttaaagggttcgggttaggtacggggaacgggtaacggggtaaccgaaacgggttccgttacggtacccggtaccgtaacggacgaaccgaaccggtaaccggtcccgtcccggtaccccgttccggtacctacctttacccg

SEQ ID NO: 424433 - DNA, 659 bp, Homo sapiens
  misc_feature: GZ8MTXP02JYI6W.51.27.C05.1.454.CMB.2.raw
  modified_base (304)..(304): a, c, t, g, unknown or other
  modified_base (480)..(480): a, c, t, g, unknown or other
  modified_base (511)..(511): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataattatgtctctgtaccaacaccaccagcaaacgccccaaactcatgatttatnatgtcagtgacgtccggccctgtacggggtttcgaattccgtccttctcgtgtcctaccgaacgtccgaccgaaccgtaccggcccctcccgacgtaccctattcccgtcgtcggggtccctcccggacggggacccggaacggggacgagggtccttagtaactttactttaacncgtcctaccctactaattaacgtaaccgaanaccgaacgaactaaacggttaggttacggggttacggtaccggggacgggtaacggaccgacgtccgtaccggtacccgtacgtaacgtaccgaccggaacccggtaacggtcccgtcccgtacccccgtcggtaccctaccgttccg

SEQ ID NO: 424434 - DNA, 697 bp, Homo sapiens
  misc_feature: GZ8MTXP02F033M.51.27.C05.1.454.CMB.2.raw
  modified_base (263)..(263): a, c, t, g, unknown or other
  modified_base (400)..(400): a, c, t, g, unknown or other
tcagcgatcgtatacacgaccggtgctcgatttagacgcgatcgaagggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctcgtgggataattgcgcgatagatattcgttcctggtatacaacagacnccacggccacgtccctgtcgtgtcatctatacaagaccaccgaagccggccctacgaggactcccgtagagcgtattcctctcggcctaccaacgtcgaggacacacgaccactctagaccatacgaggccgggacncgacggtcgtggaggacgttagggagttcgtacgttttaaccgtttttacgcggttacggtagggggtaccggttagggggaaaacctcggaccggtaacctcgggttacgggtcccgggttaggggtttaccccgggggggaccgggggaaaaccctagggtcccggttaccgggtaccccggttacccgggttccggggtaacccgaccgggaaacccccggtaacggggtcccccttcccccggggtaccccccgttcgggttacccacccgggtttccccgtttcccccccgg

SEQ ID NO: 424435 - DNA, 594 bp, Homo sapiens
  misc_feature: GZ8MTXP02F47OD.51.27.C05.1.454.CMB.2.raw
  modified_base (230)..(230): a, c, t, g, unknown or other
  modified_base (306)..(306): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttatattatgtctctggtaccaacaccacccaggcaaacgcccccaaactcatgatttatnatgtcagtgactcggcctcgaggggtttcaactcgccttctcgtggctacgaacgtccggacaaccgacggtccctaccctcgacccacttccgtccgtcgggtcctccgacgggccgaagggacgacggtctagtacttattaccgtggacctacctctaactactacgaagcaacgactaaacgtagttgggtacgttcgggacggaacggaccaaagcgtacgaccgttcgtacggtccgacgcccgaacggtccgtaccgtccccgtcggtaccaccgtttccg

SEQ ID NO: 424436 - DNA, 619 bp, Homo sapiens
  misc_feature: GZ8MTXP02JC7NW.51.27.C05.1.454.CMB.2.raw
  modified_base (201)..(201): a, c, t, g, unknown or other
  modified_base (298)..(298): a, c, t, g, unknown or other
  modified_base (304)..(304): a, c, t, g, unknown or other
  modified_base (310)..(310): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggtgttatattatgtctctgtaccacaccaccagcaaacgccccaatcatgtattanagactnacagtnacgtccggcctgtaggggtttcaattcgccttctgtcggtactcgaacgttccgctaaaccgccggccctacctcgacctacgtcttcgtcggaccttacgacgggaccggaggtaccgaggtactaggtacttacgttacgtgtaccacctactaagttaacgactaaacggccaagaaccggtaaacctaagggttggggttacggtcggggtaacgggaacggaacccgaggtccgtacgtacccggtacgtaacggtcacgaaccgaaggtcctcccggtacccctcggtacccaacgtttcccg

SEQ ID NO: 424437 - DNA, 643 bp, Homo sapiens
  misc_feature: GZ8MTXP02FHL0C.51.27.C05.1.454.CMB.2.raw
  modified_base (230)..(230): a, c, t, g, unknown or other
  modified_base (272)..(272): a, c, t, g, unknown or other
  modified_base (417)..(417): a, c, t, g, unknown or other
  modified_base (443)..(443): a, c, t, g, unknown or other
  modified_base (449)..(449): a, c, t, g, unknown or other
  modified_base (613)..(613): a, c, t, g, unknown or other
tcagcgatcgtatacacgaccggtgctcgatttagacgcgatcgaagggtttgggggctggggtctcaggaggcagcgctctcgggacgtctccaccatggcctgggctctgctattcctcacccctcctcactcagggcacgagggtcctgggcccagtctgccctgactcagcctgcctcgtgtctgggtctcctggacagtcgatcacatctctgcacgtggaaccngctaggtgtacgttggtagttatatatgtctctgtaccaacnccaccaggccaaacgtcccccaaatcatacgtatttactgactgtacagtcgactccggccgtggtacggggttacacttccgtccttaccgtcgtcgcctaccgaacggtcccggacaaaccgccggtcctacccgtacgaccnctcgtcgtcgggcctacgacggacgnggacgnggtacagttacttacttcgccgacctactactaatacggaacgaagtcccaaataccaaaggttagtcgggggttagccggggaacggacgggaaacaccggtctacccgggttaccgtacccggttacggcccgaaaccggccccgtaggacccgttcccccncccccggttagtaccccttacgttcccccg

SEQ ID NO: 424438 - DNA, 520 bp, Homo sapiens
  misc_feature: GZ8MTXP01DLI3Q.44.27.C05.1.454.CMB.2.raw
  modified_base (362)..(362): a, c, t, g, unknown or other
  modified_base (506)..(506): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctcctggtatcaacatcatccaggtaaagcccccaaactcatcatctatgaggcctataagaggccctcaggggtttctaatcgcttcacctgctcaagtccgacaacncggcctccctgacaatctctgggctccaggctgaggacgaggctgattattattgttgctacgagtattgttcgtcgcattctacttatgtcttcggaagtggaacaggtcaccgtcctaggttcagcccaaggccaacccacngttcaacttctccg

SEQ ID NO: 424439 - DNA, 558 bp, Homo sapiens
  misc_feature: GZ8MTXP01ERG8V.44.27.C05.1.454.CMB.2.raw
  modified_base (466)..(466): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggccgcaggctccaggcgaggggctggagtggggtggcaggtgtgtcatttcatggagaaatcaaagtctacggtgattccgtgaggccattcacatctccagagacaattccgagaacacagtgtctacttacaaatgaaacagacctagacgacctcaaggacacggccgtgttagttttgngtcgtagtactatctgtttaccaaagttcggttctagttcgacgccgttcggggccgagggaaccctcggtcaccgtccgttcccgtcccgg

SEQ ID NO: 424440 - DNA, 505 bp, Homo sapiens
  misc_feature: GZ8MTXP01D0PTJ.44.27.C05.1.454.CMB.2.raw
  modified_base (280)..(280): a, c, t, g, unknown or other
  modified_base (316)..(316): a, c, t, g, unknown or other
  modified_base (354)..(354): a, c, t, g, unknown or other
  modified_base (414)..(414): a, c, t, g, unknown or other
  modified_base (422)..(422): a, c, t, g, unknown or other
  modified_base (434)..(434): a, c, t, g, unknown or other
  modified_base (487)..(487): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaanccccaaatcatcatctatgagctataagaggccctnagggtttctaatcgcttcactgctcaagtccgacaacncgcctccctgacaatctctgggctcaggctgagacgaggctgattatatgttgctgagtntgttcgcnctatctacgttntgtcgttcggaagtcggaacaggtcacgtctagcacgacccaacgcccaaccntcgttactaacttcgtcg

SEQ ID NO: 424441 - DNA, 528 bp, Homo sapiens
  misc_feature: GZ8MTXP01AJ19J.44.27.C05.1.454.CMB.2.raw
  modified_base (481)..(481): a, c, t, g, unknown or other
tcagacagtatatacacgaccggtgctcgatttagacgcgatcgaagggtttgggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccgaggcgagggggctgggagtgggtggcaggtgtgtcatttcatggaggaaatcaagtctacgggtgattccgtgagggccgattcacatctccagagacaattccgagaacacagtgtctcttacaaatgaacagcctgacgacctcaggacacggccgtgtattttgngcgagacttagttcttgttcaaatcggttcattcgaacgcgtcgggg

SEQ ID NO: 424442 - DNA, 554 bp, Homo sapiens
  misc_feature: GZ8MTXP01CL6HL.44.27.C05.1.454.CMB.2.raw
  modified_base (301)..(301): a, c, t, g, unknown or other
  modified_base (335)..(335): a, c, t, g, unknown or other
tcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccnccaggctccgaggcgagggggctgggagtggggnggcaggtgtgtcatttccatggaggaaatcaaaagttctaacggtgattccggtgaggggccattcacatctcagagacaattccgagaacacagtgtctcttacaaatagaaacacgcctagacgacctacaggtacacggccgtgttaattttgttgtcgagtactaattcttgttacctaaatcggttcagttcgaccgtccgttcggggaacccg

SEQ ID NO: 424443 - DNA, 380 bp, Homo sapiens
  misc_feature: GZ8MTXP01A82OR.44.27.C05.1.454.CMB.2.raw
  modified_base (193)..(193): a, c, t, g, unknown or other
  modified_base (272)..(272): a, c, t, g, unknown or other
  modified_base (275)..(275): a, c, t, g, unknown or other
  modified_base (287)..(287): a, c, t, g, unknown or other
  modified_base (303)..(303): a, c, t, g, unknown or other
  modified_base (375)..(380): a, c, t, g, unknown or other
tcagacagtatatacacgaccggtgctcgatttagacgcgatcgaagggtttgggacagagtcaccattaccgcggacgaatccacgagtacagcctacatggagctgagcgaggctgaagatctgaagacacggccatctatttctgtgcgagagccctcgtcaactttcatagtccctctcatagtcccanacatggaaattggtcgaccctggggccagggaaccctggtcacgtctcctcgcctcaccaaggcccatcggtctccccngcncctgctccaggncacctccgagagcacngcgccctgggctgccctggtcaaggctactcctatactactgtctgagcgggctgggcaaagggcgcatagnnnnnn

SEQ ID NO: 424444 - DNA, 547 bp, Homo sapiens
  misc_feature: GZ8MTXP01C01EJ.44.27.C05.1.454.CMB.2.raw
  modified_base (486)..(486): a, c, t, g, unknown or other
  modified_base (497)..(497): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccgaggcgagggggctgggagtggggtggcgaggtgtgtcatttccatggaggaaatcaaagtctaacggtgattccgtgagggccgattcaccatctcagagacaattccgagaacacagtgtctcttacaaatagaacagcctgacgacctcaggacacggccgtgttaattttgngtcgagtactnttcgttgtttacctaaattcgttctattcgacgtccgttggggtaacccg

SEQ ID NO: 424445 - DNA, 597 bp, Homo sapiens
  misc_feature: GZ8MTXP01DMP77.44.27.C05.1.454.CMB.2.raw
tcagacagtatatacacgaccggtgctcgatttagacgcgatcgaagggtttggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagccctctggattcaccttcgataattggaatatgcagtggtccgcaggctccaggcgaggggctggagtgggtggcaggtgtgtcatttcatggaggaaatcgaaaagtctaacgggtgaatttcccggttgaacggggcccgtaatttccaccattcctccaagtagaacaagttccgaagaacacaagtgtacttcttacgaaaattgaaacaggccctgacgaccctacgacggacacggtccgttgttaattttggttcgcgttagtactattcgtttcgtttaacctaaaagttcggttctacgttacgaccgtccggttcggggaacccggg

SEQ ID NO: 424446 - DNA, 521 bp, Homo sapiens
  misc_feature: GZ8MTXP01ESPT1.44.27.C05.1.454.CMB.2.raw
  modified_base (188)..(188): a, c, t, g, unknown or other
  modified_base (222)..(222): a, c, t, g, unknown or other
  modified_base (314)..(314): a, c, t, g, unknown or other
  modified_base (363)..(363): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaagcccccaaactcatcatctatgagcctataagngccctcagggttctaatcgcttcacctgcctccaaagtcccggacaacnccggcctccctagacaatctctgggctccaggctgaggacgaggctgattattattgtgctcgagtattgttcgcgcatcactttatgtcttcggaagtgggacaaaggtcacgtctaggttcagcccaagcccaaccccatgttcaacttcgtcccg

SEQ ID NO: 424447 - DNA, 559 bp, Homo sapiens
  misc_feature: GZ8MTXP01DAFI6.44.27.C05.1.454.CMB.2.raw
  modified_base (322)..(322): a, c, t, g, unknown or other
  modified_base (364)..(364): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctnaggggtttctaatcgcttcacctgcctcaagtccggacaacncggcctccctgacatctctgggctcaggctgaggacgaggctgattattattgttgctcgagtattgttcgtgcatctaactttatgttcgttcggaaggttcgggaaccaaaggggttccaacccggttccgtaagggttccacggaccccaaagggccccaaaccccgtatcgttacctaaccgttcttcccg

SEQ ID NO: 424448 - DNA, 520 bp, Homo sapiens
  misc_feature: GZ8MTXP01DFYGE.44.27.C05.1.454.CMB.2.raw
  modified_base (187)..(187): a, c, t, g, unknown or other
  modified_base (221)..(221): a, c, t, g, unknown or other
  modified_base (361)..(361): a, c, t, g, unknown or other
  modified_base (485)..(485): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacgcccccaaactcatcatctatgaggcctataagaggccctcagggtttctaatcgcttcacctgctcaagtccgacaacncgcctcctgacatctctgggctcaggctgagacgaggctgattattattgttgctcgaagattgttcgtcgctatctacttatgtcgttcgggaagtgggaccaaggtccacgtcctaggttcngcccaaggcccaacccgatgttctaacttcgtccg

SEQ ID NO: 424449 - DNA, 556 bp, Homo sapiens
  misc_feature: GZ8MTXP01EECBD.44.27.C05.1.454.CMB.2.raw
  modified_base (405)..(405): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
  modified_base (422)..(422): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagcgtggtttcgtcgttaggccctcttaagaggtgtcatgtgtcaggtgcaattcgtggagtctgggggaggcgtggccccaggtaggggggtccctgagactctcctgtgcagcctctggattcaccttgataattggaatatgcagtggccgcaggctccaggcgaggggctggagtggggtgcaggtgtgtcatttcatggaggaaatacaagtctaccggtgtatcgttgaggccgattcacatctccagagacaataccgagacacagtntctactacaanananancagacgacgacgacgacgacgcgtgttgtttgtgtcgtagtactactcttaacttacttaaagtacgttcgtacgtcgttacgcggttcgggaaccggacggtaaccgtcgtccgttaccgtccgttccgtccg

SEQ ID NO: 424450 - DNA, 647 bp, Homo sapiens
  misc_feature: GZ8MTXP01EMIGO.44.27.C05.1.454.CMB.2.raw
  modified_base (264)..(264): a, c, t, g, unknown or other
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctcnggattcaccttgataattggaatatgcagtcgggtccnccaggctccgagggcgagggggctgggaggtggggtggcagggtgtgtcatttccagtggaaggaaatcgaaaagttcgtaacgggtgaatttcccggtggacggggccgtattcccacctatctccagagactaaacttccgaagaacacagtgtactacttaacgaaattacggaaacacgacctagacgaccgtacgaacggaaccgaaccgggtccgttggttaagtttttggttacggtacggttaacggtaacttaactttccgttacggttttaaccctaaaacgtttccggttaactaacgtttccggaccggtcccggttcgggggtaaccccggg

SEQ ID NO: 424451 - DNA, 713 bp, Homo sapiens
  misc_feature: GZ8MTXP01BFN84.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggagcgtggccccagtagggggtccctgagactctcctgtgcagcctctggattcaccttcgataattggaatatgcagtgggtccncaggctccaggcgaggggctgggagtggggtgcgaggtgtggtcatttccgagtgggaggaaatcgaaaagttcctaagggtgtaacgtttcccggttaggacggggtaccgtatttaccaacccctaattccttaccccgaaggtaaacggaaaccgtaaaactttaccccgggaaaacgtaaaccgtaacgtaacgttacgttacctttaccgtttaacgtaaaacgttaacgaaaccgtacgtacccgtacggaacgtacccgtaaccgaacgggtaaccggtaccgggtaccgttagtttaagttttcggttacggtacggttaacgtaacgttacttacgtttacgtttaacctaaacgttccggttaactacgttccggacccggtccgggttccggggtaaccg

SEQ ID NO: 424452 - DNA, 560 bp, Homo sapiens
  misc_feature: GZ8MTXP01D2H25.44.27.C05.1.454.CMB.2.raw
  modified_base (394)..(394): a, c, t, g, unknown or other
  modified_base (532)..(532): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggagaaatcaagtcacggtgattccgtgagggccgattcaccatctccagagacaattccgaagaacacagtgtctcttacaaatcgaaacagcctgacgaaccctcaaggacacgggccgtgttattttgngcgagactatctgttaccaaaattcggttctattcgacgccgtgggccacgggaaccgtcggtcaccgtctccgtcggcctccgaccacggcccactccggtcctcccctcggcccgcccttcgcctccacggcgccnccctccgaacgacgcacgcgccggcccg

SEQ ID NO: 424453 - DNA, 521 bp, Homo sapiens
  misc_feature: GZ8MTXP01AQ1EC.44.27.C05.1.454.CMB.2.raw
  modified_base (363)..(363): a, c, t, g, unknown or other
  modified_base (486)..(486): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaacttgtctcctggtatcaacatcatccaggtaaagccccaaactcatcatctatgaggcctataagaggccctcagggggtttctaatcgcttcacctgctccaagtccggacaacncggcctccctgacaatctctgggctcaggctgaggacgaggctgattattattgttgctcagtatgttcgtcgcatctacttatgtcttcggaagtgggaccaaggtcaccgtctacggttcncgcccaaggcccaacccactgttccaacttctccg

SEQ ID NO: 424454 - DNA, 622 bp, Homo sapiens
  misc_feature: GZ8MTXP01C4IKT.44.27.C05.1.454.CMB.2.raw
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccnccaggctccgaggcgaggggctgggagtggggtggcgaggtgtgtctatttccagtgggaggtaaatcaaaagttctaacgggtgtatttcccggttggacgggcctatccaccatctccagagaacaattaccgagaaacacagtcgtactcttacaaactagaaacacgcctagacgacctacgacggtaccgaccggccgttgttaacgtttttgttcggtcgaaggtacttacttacgttcgtttaacccgttaaaaacgttccgggtttaactaacgtttccggaccggtcccggttcgggggtaaccccggg

SEQ ID NO: 424455 - DNA, 716 bp, Homo sapiens
  misc_feature: GZ8MTXP01DPHOE.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccagtagggggtccctgagactcctcgtgtcgcacgtcctcgtggtacttcctaccgttacgtaaataagttaggtaaattagtgacgtagggttccggggtcccgccgagggtccctaccggaggggcggggacgggggtcgtagggggtagggttgggggtcggcggtagggttggttgtcttagttttccaggtaggggaaaggtaaatacgtaaagttcgtaacgggtagttacgtttccggtagggacgggtaccgtattacccactatcctccaagacgaactaacgttaccgaagaaccacgtagtactaccttacttaacgaaacgttacggaaacacgtcgtagacgtacctacgacggtaccgaccggtccgttgtttaagtttggcggtacgaacgtaacttcttacgtttacctttaaaccgtaaacgttccggttaacttacgtaccggttaccggtccggttaacggggtaacccgg

SEQ ID NO: 424456 - DNA, 620 bp, Homo sapiens
  misc_feature: GZ8MTXP01DWVRK.44.27.C05.1.454.CMB.2.raw
  modified_base (302)..(302): a, c, t, g, unknown or other
  modified_base (547)..(547): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggattcaccttcgataattggaatatgcagtggtccncaggctccgaggcggagggctgggagtgggtggcgaggtgtgtcatttccagtgggaaggaaatcgaaaagttcgtaacgggtgtacgtttcccgggttgaacgggggcccgtaatttcccaaccctattcctaccaagacgaaactaaacgttacccgaagaaaccacgagttcgtacttacttacaaaattacgaaacacgcctagacgacctacgacggtacaccggtcgtgttaattttgngtcgagtacttattcgttcgttacctaaaagttcggttaactagttccgacggtccgttcggggtaaccccgg

SEQ ID NO: 424457 - DNA, 946 bp, Homo sapiens
  misc_feature: GZ8MTXP01DZVZC.44.27.C05.1.454.CMB.2.raw
  modified_base (189)..(189): a, c, t, g, unknown or other
  modified_base (264)..(265): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcactggagccagcgtaatattcttagtcttaacttgtctctgtatcaacnncatccaaggtaaacgccccaaactcatcatctatgacggacctaataacgacggtccccttacgtaacgggggtttttactaaacgttccggtcctttacctaaccccgttcggtaccccttacccgtaaaaccgggttcccccggggaaacccaaacccgtaacccggggtcccccttacccccgttacggaaaccctaaaaccttcccgttccgggttacgggggtcccctttacccggaaaggggtcccgttaggggaaacgggggaaacccgggtaaggggttacccgtttagggttaaactttttaaagtttttaaacgtttggggttttacggttccccctttacggggttaaaacgggtttaggttttttaccgggttttacccggtttccggtacccttaacgtttacccgttaaaaccctttttaaagtttccgggttttacccggtttaaccggggggtaaacgggtttaacccggggggtaaaccccggttaaacggggttttaccccccgttaaaccccggggttttaccccggttaaacggggtttaaccccgttaaccccggggttaaaccccccgtaaaacccgggggaacccccccctaaaaccccccggtaacctttccggggttacccccttaacccgtttccccggtttttaaccccccccg

SEQ ID NO: 424458 - DNA, 520 bp, Homo sapiens
  misc_feature: GZ8MTXP01D1K3T.44.27.C05.1.454.CMB.2.raw
  modified_base (189)..(189): a, c, t, g, unknown or other
  modified_base (223)..(223): a, c, t, g, unknown or other
  modified_base (281)..(281): a, c, t, g, unknown or other
  modified_base (375)..(375): a, c, t, g, unknown or other
  modified_base (392)..(392): a, c, t, g, unknown or other
  modified_base (506)..(506): a, c, t, g, unknown or other
tcagacagtatatacacgaccggtgctcgatttagacgcgatcgaagggtttgggggggtcacaagaggcagcgctctcgggatgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaactttgctcctggtatcaacatcatccagtaaacncccccaaatcatcatctatgagctataagagccctgagggtttcaatcgcttccactgcctcaagtccgacaacacgcctccctgacaatctcnggctccagctgagacgngctgattattattgttgctcagtatcgttcgtcgctatctactttatgtcttggaaagtcgggaacctaaaggttccaaccgtcttagggttcacggcccaaaggcccaacccncttgtccaacttcc

SEQ ID NO: 424459 - DNA, 610 bp, Homo sapiens
  misc_feature: GZ8MTXP01ETTAQ.44.27.C05.1.454.CMB.2.raw
  modified_base (264)..(264): a, c, t, g, unknown or other
  modified_base (388)..(388): a, c, t, g, unknown or other
  modified_base (519)..(519): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctntggattcaccttgaataattggaatatgcaggtggtccgccaggctccgagggcgagggggctgggaggtggggtggcaggttgtgtcatttccagtggaagaaatcgaaaagtctaacgggtntagtttccggtgacgggccattcaccatctcagagactaattccgaagaacactagtgtactcttacgaaatcgaaacacgacccgacgaccgtacgaacggaccgtaccggtaccgttgttatttttggngttacggacgttacttacttcgttacgtttacccaaaagtttccggttactaacgtttccggaccggttccgtcggggcccgtaaccgggg

SEQ ID NO: 424460 - DNA, 548 bp, Homo sapiens
  misc_feature: GZ8MTXP01B14C5.44.27.C05.1.454.CMB.2.raw
  modified_base (188)..(188): a, c, t, g, unknown or other
  modified_base (284)..(284): a, c, t, g, unknown or other
  modified_base (386)..(386): a, c, t, g, unknown or other
  modified_base (405)..(405): a, c, t, g, unknown or other
  modified_base (458)..(458): a, c, t, g, unknown or other
tcagacagtatatacacgaccggtgctcgatttagacgcgatcgaagggtttggggggtcacaagaggcagcgctctcgggacgtctccaccattgcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaaggtaaacncccccaaatcatcatctatgaggcctaataagacggcccttcgtagggggtttactaaagtccgctttcaacctcggcctaccgaaacgtcccggacaaacnccggcctccctgacaatcnctggctccaggctgaggacaggctgattattattgtagctgatatgttcgtcntatctacttatgtcttcggaagtggaccttaaggtccacgtcgtagttccagaccccaaggccccaaacccgctcgttcaacttctcccg

SEQ ID NO: 424461 - DNA, 590 bp, Homo sapiens
  misc_feature: GZ8MTXP01DK6BK.44.27.C05.1.454.CMB.2.raw
  modified_base (213)..(213): a, c, t, g, unknown or other
  modified_base (285)..(285): a, c, t, g, unknown or other
  modified_base (315)..(315): a, c, t, g, unknown or other
  modified_base (400)..(400): a, c, t, g, unknown or other
  modified_base (562)..(562): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccnccaggctccaggcgaggggctggagtgggtggcagggtgtgtcatttcatggaggaaatcaagtctacggtnattccgtgagggccattcacatctccaganacaattccgagaacacagtgtctcttacaaatcgaacagccctgacgaaccctgaaggacaccgggtccgttgttacgtttttgngcgagtactatctgtttaccaaaattcggttactattccgacgccgtaggggcctaacggggaacccgtggtccgaccgttcctcccgtccggccctcccaccgaacgggtcccacgtcccggtccttcccccgtggccgcccttcgcctccgacggcgccnccctccgaacgcgcacgcgccggtcccg

SEQ ID NO: 424462 - DNA, 382 bp, Homo sapiens
  misc_feature: GZ8MTXP01DGEI0.44.27.C05.1.454.CMB.2.raw
  modified_base (278)..(278): a, c, t, g, unknown or other
  modified_base (290)..(290): a, c, t, g, unknown or other
  modified_base (372)..(372): a, c, t, g, unknown or other
  modified_base (378)..(382): a, c, t, g, unknown or other
tcagacagtatatacacgaccggtgctcgatttagacgcgatcgaagggtttgggacagagtcaccattaccgcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccaccaaggcccatcggtctcccctgcncctgctccaggngcacctccgagagcacagcggccctgggctgccctggtcaaggactactcctatatactgtctgaagcgggctggcaaggcncatagnnnnn

SEQ ID NO: 424463 - DNA, 523 bp, Homo sapiens
  misc_feature: GZ8MTXP01ATDOY.44.27.C05.1.454.CMB.2.raw
  modified_base (303)..(303): a, c, t, g, unknown or other
  modified_base (375)..(375): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataatggaatatgcagtggtccnccaggctccgaggcgaggggctggagtgggtggcaggtgtgtcatttcatggagaaatcaagtctacgggtnattcgtgaggggccattcacatctccagagacaattccgagaacacagtgtctcttacaaatgaacagcctgagacctcaggacacggccgtgtatttgtgcgtagacttattcttgttaaccaaatcgttcattcgaacgcgtcggg

SEQ ID NO: 424464 - DNA, 535 bp, Homo sapiens
  misc_feature: GZ8MTXP01D6MZ4.44.27.C05.1.454.CMB.2.raw
  modified_base (235)..(235): a, c, t, g, unknown or other
  modified_base (325)..(325): a, c, t, g, unknown or other
  modified_base (365)..(365): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatnttcttagtcttaactttgtctcctggtatcaaacatcatccaggtaaagcccccaaactcatcatctatgaggcctataagaggcccctnaggggtttctaatcgcttcactgcctcaagtccgacaacncggcctccctgacaatctctgggctcaggctgaggacgaggctgattattattgttgctcgagtattgttcgtcgcatctaactttatgttcgttcgggaagtggggaaccaaaggtccaccgtctagggcttattgtcgactcgtaaggaattgaaccgaaggaagggg

SEQ ID NO: 424465 - DNA, 547 bp, Homo sapiens
  misc_feature: GZ8MTXP01D7QWR.44.27.C05.1.454.CMB.2.raw
  modified_base (190)..(190): a, c, t, g, unknown or other
  modified_base (224)..(224): a, c, t, g, unknown or other
  modified_base (269)..(269): a, c, t, g, unknown or other
  modified_base (283)..(283): a, c, t, g, unknown or other
  modified_base (319)..(319): a, c, t, g, unknown or other
  modified_base (363)..(363): a, c, t, g, unknown or other
  modified_base (444)..(444): a, c, t, g, unknown or other
  modified_base (524)..(524): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaactttgtctcctggtatcacancatccaggtaaacnccccaaatcatcatctatgagcctataagcgccctnaggggtttctaatcgcttcacctgcctccaagtcccggacaacnccggccctccctgacaatctctgggctcaggctgaggacgaggctgtattattattgttgctcgtagtattcgttcggtcnctatctaactttatgtacttcggaaggtggaaccaaggtcacccgtcgtacggttcacgaccccgaaggccccaaccccnctcgttctaacttccgttaaccc

SEQ ID NO: 424466 - DNA, 559 bp, Homo sapiens
  misc_feature: GZ8MTXP01AFJGY.44.27.C05.1.454.CMB.2.raw
  modified_base (332)..(332): a, c, t, g, unknown or other
tcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccgccaggctccgaggcgaggggctgggagtgggngcgaggtgtgtcatttccagtggaggaaatcgaaaagtctaacgggtgacgtttccggttagacggggccgtatttccaccctaatcctccagagacaattccgaagaacacagtgtctctacgaaatgaacagcctgacgacctcgacggacacggccgtgttaattttgttgcgagtactattcttgttaccaaatcggtcattcgacgtccgttggggaacccg

SEQ ID NO: 424467 - DNA, 509 bp, Homo sapiens
  misc_feature: GZ8MTXP01AJVHR.44.27.C05.1.454.CMB.2.raw
  modified_base (364)..(364): a, c, t, g, unknown or other
  modified_base (381)..(381): a, c, t, g, unknown or other
  modified_base (495)..(495): a, c, t, g, unknown or other
  modified_base (501)..(501): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctcctggtatcaacatcatccaggtaaagcccccaaatcatcatctatgagcctataagaggccctcaggggtttctaaatcgcttcacctgcctccaagtccggacaacncggcctccctgacatcnctgggctccaggctgaggacgaggctgattattattgtgctgagatgttcgtcgcatcacttatgtcttcggaagtgggaccaggtcacgtctagttcagcccaagccaacccntgttcncgttctcg

SEQ ID NO: 424468 - DNA, 537 bp, Homo sapiens
  misc_feature: GZ8MTXP01EPDFZ.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (323)..(323): a, c, t, g, unknown or other
  modified_base (361)..(361): a, c, t, g, unknown or other
  modified_base (369)..(369): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaactttgtctcctggtatcaacatcatccaaggtaaacgcccccaaactcatcatctatgagcctataagaggccctnagggtttctaatcgcttcactgctcaagtccgacaacncgcctccngacaatctctggctccaggctgagacgaggctgattattattcgttgctcagtatgttcgtcgctatctactttatgttcttcggaaggtggaaccaaagggtccaccgtcgtaggttcacgccccaagggcccaaacccctctcgttacctaaccgttcttccccgg

SEQ ID NO: 424469 - DNA, 560 bp, Homo sapiens
  misc_feature: GZ8MTXP01CSWRM.44.27.C05.1.454.CMB.2.raw
  modified_base (307)..(307): a, c, t, g, unknown or other
  modified_base (385)..(385): a, c, t, g, unknown or other
  modified_base (417)..(417): a, c, t, g, unknown or other
  modified_base (503)..(503): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgtgggttttcctcgttagccctcttaagaggtgtcatgtgtcaggtgcaattcgtggagtcgtggggggaggcgtggccccaggtaggggggtccctgagactctcctgtgcagcctctggattcaccttcgataattggaatatgcagtgggtccnccaggctccgaggcgagggggctgggagtgggtggcaggtgtgtcatttccagtggagaaatcaaaagttctaaggtnattccggtgaggggccattcaccatctcaganacaattaccgagaacacagtgtactcttacaaattagaacaagcctagacgacctacacggaccacggtccgtgttaatttttggngtacgagtactacttcgttcttactaaatcgtaactacgtcgacgtccgttcgggcg

SEQ ID NO: 424470 - DNA, 675 bp, Homo sapiens
  misc_feature: GZ8MTXP01AU8MG.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccgccaggctccgaggcgagggggctgggaggtgggtggcgagggtgtgtcatttccagtggaaggaaatcgaaaagttccgtaacgggtgtacgtttccggttaggacggggtcccgatttccacctatcctacccgaaggaacgaacctaaacgttacccgaagaaaccgaacgacgttacgtacttacttacgtaaattacgaaacacgtacccgtagaacgacccgtacgaacggtaccgaccgggtcccgttgtttaagtttttggttggtaccgttagtaacgttacttacgttcggtttaaccctaaaaacgttccgggtttaactacgtttaccgggacccggtcccggttcgggggtaaccccgg

SEQ ID NO: 424471 - DNA, 604 bp, Homo sapiens
  misc_feature: GZ8MTXP01A91RR.44.27.C05.1.454.CMB.2.raw
  modified_base (303)..(303): a, c, t, g, unknown or other
  modified_base (343)..(343): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccnccaggctccaggcgagggggctggagtgggtggcaggtgngtcatttccatgggaagaatcgaaaagtcgtaacgggtgtaactttcccgggttaggacggggccgtatttcccaccctatcctaccgaagacgaactaaacgttaccgaacgaaccacgaagtcgtacttacttacaaattacggaaacacgcctacgacgacctacgacggaccgaccggtccgtgttaattttgcgtcgagtactacttcgttgttactaaatcggttaacacgttcgaccgtcgttcggggaacccg

SEQ ID NO: 424472 - DNA, 611 bp, Homo sapiens
  misc_feature: GZ8MTXP01BXTS1.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggattcaccttcgataatggaatatgcaggtcgggtccgccaggcctccgagggcggagggggctgggaggtggggtggcgagggtgtgtctatttcagtgggaagaaatcaaagtcgtacgggtgtagtttcccggtaggacggggtccgtattccacctactctccaagaacgaacaacttaccgaagaacacagtagtctacgttacaaatagaacacgcctagacgacctcgaacggaccgaccgggtccgttgttattttggtgcgtagtacttacttcgttacgtttaacctaaaagttcggttactacgttaccgtaaccgttccgtaaccgggg

SEQ ID NO: 424473 - DNA, 373 bp, Homo sapiens
  misc_feature: GZ8MTXP01BET7K.44.27.C05.1.454.CMB.2.raw
  modified_base (271)..(271): a, c, t, g, unknown or other
  modified_base (274)..(274): a, c, t, g, unknown or other
  modified_base (280)..(280): a, c, t, g, unknown or other
  modified_base (284)..(284): a, c, t, g, unknown or other
  modified_base (340)..(340): a, c, t, g, unknown or other
  modified_base (363)..(363): a, c, t, g, unknown or other
  modified_base (369)..(373): a, c, t, g, unknown or other
tcagacagtatatacacgaccggtgctcgatttagacgcgatcgaagggtttgggacagagtcaccattaccgcggacgaatccacgagtacagcctacatggagctgagcgaggctgagatctgaagacacggccatctatttctgtgcgagagccctcgtcaactttcatagtccctctcatagtcccacacatggaaattggttcgacccctggggccaggaccctggtcaccgtctcctcggcctccaccaggcccatcgtctcccngcncctgcncagncacctcgagagcacagcggccctgggctgcctggtcaaggctactcctatactacngtctgagcgggctggcaagggcncatagnnnnn

SEQ ID NO: 424474 - DNA, 826 bp, Homo sapiens
  misc_feature: GZ8MTXP01CL8VI.44.27.C05.1.454.CMB.2.raw
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccnccaggctccgaggcgaggggctgggagtgggtggcagggtgtgtcatttccagtgggaaggtaaatcgaaaagttctaacgggtgtaacgtttcccgggttagggaacgggggtccccgtaaatttaccccgtaacccgtaacgttacccttaccccgaaggaaacggtaaacccgtaaaacgttttaccccgggaaacgggtaaaacccaaacccgtaagggtttaccgggttaccgtttaccccgttttaaaccgtaaaaaactttaacggggtaaaaacccaacggtaccccgttaaccggaaccgggtaaccccttaaccgaaaccggggtaaacccgtaacccggggtaccccggtttagggtttaaacgtttttttcgggttaggttacccggttaaagggttaaacctttaacgttaccctttacgggtttttaaccctaaaaaacgtttccggggtttaaccttaaccggtttaccggttaacccggtaaccccgggttcggggggtaacccccggg

SEQ ID NO: 424475 - DNA, 598 bp, Homo sapiens
  misc_feature: GZ8MTXP01D8ICB.44.27.C05.1.454.CMB.2.raw
  modified_base (290)..(290): a, c, t, g, unknown or other
  modified_base (302)..(302): a, c, t, g, unknown or other
  modified_base (528)..(528): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctctgtgcagcctcgtggattcaccttcgataattggaatangcagtcggtccncaggctcaggcgagggctgggagtgggtgcgtaggtgtgtcgatttcgatgggaacgaaatcgaaaagtcgtaacggtgtacttccggtagacgggtccgtattccacctactctaccgaagaacgaactaaactccgaacaaactaacgacgtcttactactttaacgaaattacgaaacacgtccagacgaccacgacggaccaacggtccgtgttaattttgngtcgagtacttattacgttcgttaacctaaaattcggttaactacgtcgacgtccggttcgggaacccgg

SEQ ID NO: 424476 - DNA, 506 bp, Homo sapiens
  misc_feature: GZ8MTXP01D3RDR.44.27.C05.1.454.CMB.2.raw
tcagacagtatatacacgaccggtgctcgatttagacgcgatcgaagggtttgggggtcacaagaggcagcgctctcgggacgtctccaccatggcctgggctctgctgctcctcactctcctcactcaggacacagggtcctgggcccagtctgccctgactcagcctgcccccgtgtctgggtctcctggacagacgatcaccatctcctgcactggaagcagcagtgacgttggtgcttataactttgtctctggtatcaacaatatccaggcagacgccccaaactcatcatttatgatgtcagtcatcggcctcgaggggtttcctaatcgcttctctcgctccaagtctggcaacacggcctcctgaccatctcgtgggctccgaggctgaggacgaggctgattactactgcagctcatatacaagcagcaagccaccctattgtcttcgaacgttgggaccaagggtcaaccgtcctaggttccaacggccccaacgg

SEQ ID NO: 424477 - DNA, 567 bp, Homo sapiens
  misc_feature: GZ8MTXP01BV0W6.44.27.C05.1.454.CMB.2.raw
  modified_base (300)..(300): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttgataattggaatatgcagtgggtccncaggctccaggcgagggggctgggagtgggtgcaggtgtgtcatttcagtggaggaaatcgaaaagttctaacgggtgagttcccggttgacggggtcccgtaatttccaccctatctactagacgaacaacttaccgagaacacagtacgtctacttacaaatgaacacgcctgacgactcgacgtacgacggtccgtgttaattttgttgcgagtactattcgttgtttaccaaatcgtctattcgacgtccgttcgggaacccg

SEQ ID NO: 424478 - DNA, 627 bp, Homo sapiens
  misc_feature: GZ8MTXP01B1GK0.44.27.C05.1.454.CMB.2.raw
  modified_base (306)..(306): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtcggccccgaggtacggggggtccctgagactctcctgtgcagcctctggattcaccttcgataattggaatatgcagtcggtccnccaggctccgaggcgagggggctgggaggtggggtggcgagggtgtgtcatttccgagtgggaagtaaatcgaaaagttctaacgggtgaacgtttcccggttaggacggggcccgtattcccgacctactcctacagaagacaaacgttaccgaagaacacagtgtctcttacgaaatacgaaacacgtcctagacgacctacgacggaccgacggtccgttgttaagttttggttggtacgttacgtacttacttcgttcgtttacccgtaaaagttcggttaactacgttacgaccggtccggttcggggtaacccgg

SEQ ID NO: 424479 - DNA, 688 bp, Homo sapiens
  misc_feature: GZ8MTXP01EANPI.44.27.C05.1.454.CMB.2.raw
  modified_base (336)..(336): a, c, t, g, unknown or other
  modified_base (402)..(402): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttgataattggaatatgcagtgggtccgccaggctccgaggcgagggctggagtgggtggcaggtgtgtcatttcagtggagaaatcaagtctacggtgattccgtgagggccattcaccatctccagagacaattccgaagaacacagtntctctacaaatcgaaacagcctagacgaaccctcgaagggaccacgggtccgttgttatttttggngtacgagtacttatcttacgtttaacaaaagtttcggttactaacgttccggaccgtcccgtacgggggaccgtaaccggggtaacccgttcgggttacccgtaacccggttccgttaccccgttcccgggaccccttaccccgaacccggtaaaccggggtccccctaacggtttccccgggttccccgtttcccccccgtggggccccgtccccgttcgtcccgttacccgacgggcacccgtaacccgtaccggaacgacgccgaccgccggcccggtcccgg

SEQ ID NO: 424480 - DNA, 593 bp, Homo sapiens
  misc_feature: GZ8MTXP01CQ59I.44.27.C05.1.454.CMB.2.raw
  modified_base (189)..(189): a, c, t, g, unknown or other
  modified_base (222)..(222): a, c, t, g, unknown or other
  modified_base (373)..(373): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcactgganccagcggtaaatattcttagtcttaactttgtctcctggtatcaaacatcatccaaggtaaacgcccccaaactcatcatctatgaggcctaataagaggccctgtagggggtttctaatcgcttcacctgcctcaacgtccggaacaacnccggcctcctgacaatctctggctcaggctgagacgaggctgtattattattgttgctcgagtattgttcgtcgctattctaacttatcgtcgttacggaaggttcgggaaccttaacggggtccacccggttccgtaacgggttaccgaacggaccccgaaaccgggcccctaaacccccgtaacgtcggttaccctaacccgttccgttttcccccgg

SEQ ID NO: 424481 - DNA, 604 bp, Homo sapiens
  misc_feature: GZ8MTXP01D7UDA.44.27.C05.1.454.CMB.2.raw
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggaatcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggccncaggctcgaggcgaggggctgggaggtgggtggcgaggtgtgtctagtttccagtggaaggtaaatcgaaaagttcgtaacgggtgtacgtttcccggttaggacggggtcccgaatttccacctacttacctccaagagaactaaacttaccgaagaacacagtcgtactacttacgaaatcgaaacacgcctagacgacctacgacggacgaccggtccgttgttaagttttgttgtcgttagtacttattcgttcgttactaaattcggttcacgttcggacgtccgttcgggtaaccgg

SEQ ID NO: 424482 - DNA, 635 bp, Homo sapiens
  misc_feature: GZ8MTXP01DGOQV.44.27.C05.1.454.CMB.2.raw
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtagggggtccctgagactctcctgtgcagcctctggattcaccttcgataatggaatatgcagtggtccncagctccgaggcgaggggctggagtgggtgcgaggtgtgtctatttcagtggaaggaaatcgaagttcgtacgggtgacgtttcccggtaggacggggtccctaattccaaccactcctaccagacgaactaacttaccgaagaacacagtacgtaccttacgttacaaatagaaacacgcccgtagaacgtaccacgacggaccgtaaccgggtccgttaagtttaagtttttcggtggttacgtaacgtaacttacgttctttacggtttaacctaaaaacgttccggtttactacgttaccgtaaccggttcccggtaacccggggg

SEQ ID NO: 424483 - DNA, 599 bp, Homo sapiens
  misc_feature: GZ8MTXP01AT1HG.44.27.C05.1.454.CMB.2.raw
  modified_base (188)..(188): a, c, t, g, unknown or other
  modified_base (234)..(234): a, c, t, g, unknown or other
  modified_base (268)..(268): a, c, t, g, unknown or other
  modified_base (580)..(580): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatnttcttagtcttaactttgtctcctggtatcaacntcatccagtaagacccaacctacatacatctactagaggacgtactaagtaggacccgtcctagggtttacggttaactacgtcgttcctaccctcgtccgtccctaacgtaccggacccgaaccaaccggccgtcccctcgtacaaactctctcggcgtccacggcgtgaggacgaggcgtgattagttattgttgtctcgtagtagtgttcgtacgcatctactattgtcgttcggaggtaagggtaccgaaggttcgacccgtaccgttgttaccgttacgacccgaaccgaccgaaccccaacccgtnttcctaaccttcgttcccg

SEQ ID NO: 424484 - DNA, 577 bp, Homo sapiens
  misc_feature: GZ8MTXP01E1XFN.44.27.C05.1.454.CMB.2.raw
  modified_base (460)..(460): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggattcaccttcgataattggaatatgcagtcggtccgcaggctccgaggcgaggggctgggagtgggtggcaggtgtgtctatttcagtggaagaaatcaaagtcgtacggtgtattccggttgacggggcctattcacatctccagagaacaattaccgagaacacagtgtactacttacaaatgaacancctgacgacctcgagaccgacggtccgttgttagtttttggcgttacgtaacgtaacttacgttcgttacgttaactaaacgttcgttactacgttaccgtaaccgttccggtcggg

SEQ ID NO: 424485 - DNA, 557 bp, Homo sapiens
  misc_feature: GZ8MTXP01D3B38.44.27.C05.1.454.CMB.2.raw
  modified_base (302)..(302): a, c, t, g, unknown or other
  modified_base (498)..(498): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctccaggcgaggggctgggagtgggtggcaggtgtgtcatttccatggaggaaatcgaaaagtctaacgggtgtagttccgttgagggccgattcaccatctccagagacaaattccgaagaacacagtgtctcttacaaatgaaacagcctgagacctacgacggtaacacggtcccgtgttaattttggngcgagtactattcgttgttacctaaaatcggttcagttcgacgtccgttggggaacccg

SEQ ID NO: 424486 - DNA, 568 bp, Homo sapiens
  misc_feature: GZ8MTXP01CH2DN.44.27.C05.1.454.CMB.2.raw
  modified_base (484)..(484): a, c, t, g, unknown or other
  modified_base (566)..(566): a, c, t, g, unknown or other
  modified_base (568)..(568): a, c, t, g, unknown or other
tcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaattcggttacattccgcgcgtggggccagggaaaccctgggtcacccgtctcctcggcctccacacgggcccagtccggtccttcccccgtggcccgccctcgctcccaggcgccacctccgacggacgcacgacgccggcccgngggctcgcctgggtccaacgggtcctaacgttcccttatacttacgtcgtcttggcgttcgggctggccaaggccgataagngn

SEQ ID NO: 424487 - DNA, 670 bp, Homo sapiens
  misc_feature: GZ8MTXP01BK6KR.44.27.C05.1.454.CMB.2.raw
  modified_base (315)..(315): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctgtggtattccaccttcgaattaagtggaatatgctaggtcgggtcccncgaggcctccgagggcggaggggtctgggaggtggggtggcgagggtgtgtctagtttcgagtgggaagtaaactacgaagtcgtacgggtagtacgtttcccggtagggacgggtccgtattaccaccgtactcctaccaagacgaactaaacgttaccgaacgaaaccacgtagttcgttaccttacttaactaaagtacgaaacgcgtaccccgtagaacgaccctacgtaacgggaccgtaaccgggtccgttaagtttacttttggtcgacggtactaacgttacttcttacggtttaaaccctaaaggttccgttactacgttaccggaaccgttcccgtaaccggggg

SEQ ID NO: 424488 - DNA, 592 bp, Homo sapiens
  misc_feature: GZ8MTXP01ANAGT.44.27.C05.1.454.CMB.2.raw
  modified_base (223)..(223): a, c, t, g, unknown or other
  modified_base (369)..(369): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaaggtaaacgcccccaaactcatcatctatgagcctataagaggccctcgaggggtttctaatcgcttcacctgcctccaacgtccgaacaacncggccctccctgacaatctctgggcctcgaggctgaggacgaggcttgatttattattgttgctcgagtagttgttcgtcgctatctacttagtgttcgttacgggaaggttcgggaaaccgttacgggttacccgaccggttacccgtagggttacccgacggaccccgaacgggaccccaaacccccgtcgtacgttaccctaaccttcccgtttccccgg

SEQ ID NO: 424489 - DNA, 569 bp, Homo sapiens
  misc_feature: GZ8MTXP01EQC9W.44.27.C05.1.454.CMB.2.raw
  modified_base (396)..(396): a, c, t, g, unknown or other
  modified_base (560)..(560): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctaggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtcacggtgattccgtgaggccattcacatctccagagacaattccgagaacacagtgtctcttacaaatcgaaacagcctagacgaaccctcaaggacacgggtccgttgttatttttggngcgagtactatctagtttaccaaaattcggttactattcgacgccgtggggaccacgggaacccgtggtccaccgtctccgtcggccctccaccgaacgggcccacgtccggtcctccccgtggccgcccttgcctccgaggcgccaacctccgaagacgcacncgcggcccg

SEQ ID NO: 424490 - DNA, 625 bp, Homo sapiens
  misc_feature: GZ8MTXP01A3QH9.44.27.C05.1.454.CMB.2.raw
  modified_base (283)..(283): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggccncaggctccgaggcgaggggctgggagtggggtggcgaggtgtgtcatttcatggagaaatcgaagtctacggtgattccggttgagggccattcacatctccagacgacaatccgagaacacagtgtctcttacaaatgaaacagcctagacgaccgtacgaacggaccgaccgggtccgttagttacgtttttggtgtacggtagtaacttacttcgttaacgttttaaccttaaaagttccggttactacgtttccggaaccggttcccgttcgggggtaaccccgacggggtaaccccgttcgggtacccgttacccggttcccgttcccgtccccggg

SEQ ID NO: 424491 - DNA, 565 bp, Homo sapiens
  misc_feature: GZ8MTXP01D8TZN.44.27.C05.1.454.CMB.2.raw
  modified_base (296)..(296): a, c, t, g, unknown or other
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagttgggctgagctgggttttcctcgttgccctcttaagaggtgtcatgtgtcaggtgcaattcgtggagtcgtgggggaggcgtgggccccaggtaggggggtccctgagactctcctgtgcagcctctggattcaccttcgataatggaatatgnagtggtccncaggctccgaggcgagggggctgggagtggggtggcaggtgtgtcatttcagtggagaaatcaaagtcgtacggtgtaagtttcccggtggacggggtccgattcacctatctccagacgaacaacttaccgagaacacagtgtctcttacaaatacgaacagctgacgacctcgaggacgacggtccgtgttattttgtgttcgagtacttattcttagttaacctaaaagtcgttcacgttcgtaacgttcgtcgggg

SEQ ID NO: 424492 - DNA, 587 bp, Homo sapiens
  misc_feature: GZ8MTXP01D7YLA.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcagtgggtccgcaggctccgaggcgaggggctgggaggtgggtggcaggtgtgtcatttcatggaggaaatcgaaaagtctaacgggtgtagttcccggttaggacggggtccaagtttccaccctatctcccgagtacgaactaaattacccgaagaacacagtcgtacttacttacaaaattacgaaacagaccctgaacgacctacacggaccacggtccgtgttaattttcgttgcgagtactattcgttgttacaaaattcggtctattccggacgtccgttcggggaacccg

SEQ ID NO: 424493 - DNA, 528 bp, Homo sapiens
  misc_feature: GZ8MTXP01DLZTE.44.27.C05.1.454.CMB.2.raw
  modified_base (189)..(189): a, c, t, g, unknown or other
  modified_base (365)..(365): a, c, t, g, unknown or other
  modified_base (490)..(490): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaaatattcttagtcttaactttgtctcctggtatcaacatcatccaggtaaagcccccaaactcatcatctatgaggcctataagaggccctcaggggtttctaatcgcttcacctgcctcaagtccggcaacncggcctccctgacaatctctgggctcaggctgaggacgaggctgattattattgttgctcgagtatgttcgtcgcatctactttatgtcttcgggaagtcgggacaggtcaccgtctaggttccngacccaaggacccaacccgctgttctaacttcttcccg

SEQ ID NO: 424494 - DNA, 545 bp, Homo sapiens
  misc_feature: GZ8MTXP01EUO6K.44.27.C05.1.454.CMB.2.raw
  modified_base (301)..(301): a, c, t, g, unknown or other
  modified_base (342)..(342): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtggtccncaggctccaggcgagggggctgggagtggggtggcaggtgngtcatttcattggaggaaatcaaaagtctcggtgattccgttgaacggggtcgatttcacctatctccagagactaattccgaagaacacagtgtctcttacaaatgaacagcctgacgacctcaggacacggccgtgtaattttgttgtcgagtactattcttgttaccaaatcggttcattcgacgtccgttggggaaccg

SEQ ID NO: 424495 - DNA, 586 bp, Homo sapiens
  misc_feature: GZ8MTXP01DPCVZ.44.27.C05.1.454.CMB.2.raw
  modified_base (304)..(304): a, c, t, g, unknown or other
  modified_base (343)..(343): a, c, t, g, unknown or other
  modified_base (430)..(430): a, c, t, g, unknown or other
  modified_base (512)..(512): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccaggtaggggggtccctgagactctcctgtgcagcctctggattcaccttcgataaattgaatatgcagtgggtccnccaggctccaggcgaggggctggagtgggtggcgaggtntgtcatttccatgggaggaaatcgaaaagttctaacgggtgattccggttgaggggccaattcaccatctcagagacaattccgaanaacactagtgtactactacgaaatacgaaacacgacctgacgaccgtacgaacggtaccgacggtcgttagttaattttggngtcgagtactattcgttacgtttaacctaaagttcgttaactacgttccggaccgtccggttcggggtaacccg

SEQ ID NO: 424496 - DNA, 744 bp, Homo sapiens
  misc_feature: GZ8MTXP01C7G92.44.27.C05.1.454.CMB.2.raw
  modified_base (301)..(301): a, c, t, g, unknown or other
  modified_base (307)..(307): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcagtggtccncaggcncgaggcgagggctgggagtggggtggctaggtgtgtcagtttccgagttgggaaggaaaactcgaaaaaggttcgtaacggggttagtaacgtttcccgggttaggacgggggtaccccgtaatttacccgaaccctagttcctacccgaaggtaacgaaactaaacgtttaccccggaaaggtaaaccctaacgacgttacggttacccttaccgtttaaaccgaaaaacttaggaaaacctaacgggacccttaacgggaaaccgacccttaaccgaacggggtaacccgaccgggtaccccggtttgtttaacgtttttggttacggaccggttaagttaacccgttagtttccttacggttttaaacccctaaaaggttccggtttaacctaacgtttccggaaccggtcccggttaacgggggtaaccccgg

SEQ ID NO: 424497 - DNA, 511 bp, Homo sapiens
  misc_feature: GZ8MTXP01DIWYQ.44.27.C05.1.454.CMB.2.raw
  modified_base (323)..(323): a, c, t, g, unknown or other
  modified_base (366)..(366): a, c, t, g, unknown or other
  modified_base (385)..(385): a, c, t, g, unknown or other
  modified_base (430)..(430): a, c, t, g, unknown or other
  modified_base (474)..(474): a, c, t, g, unknown or other
  modified_base (479)..(479): a, c, t, g, unknown or other
  modified_base (494)..(495): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctcctggtatcaacatcatccaggtaaagcccccaaactcatcatctatgaggcctataagaggccctnaggggtttctaatcgcttcacctgcctccaagtccggacaacncggcctccctgacatctcngggctcaggctgaggacgaggctgattattattgtgcttcgagtntgttcgcgcatcacttatgtctggaagtggaccaggtcacgtcngttcngcccaagccaacccnncgttctaacttctccg

SEQ ID NO: 424498 - DNA, 611 bp, Homo sapiens
  misc_feature: GZ8MTXP01B0BLQ.44.27.C05.1.454.CMB.2.raw
  modified_base (267)..(267): a, c, t, g, unknown or other
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggtttttcctcgttgccctcttaagaggtgtcatgtgtcaggtgcaattcgtggagtcgtgggggaggcgtggccccgaggtagggggtccctgagactctcctgtgcagcctntggattcaccttcgataatggaatatgcagtggtccncaggctccaggcgagggggctgggagtgggtggcaggtgtgtcagtttccagtggagaaatcaaaagtctaaggtgtattcccggttggacgggtccgattcacctatcctaccgagtagaactaaacttccgaagaacacagtcgtactacgttacaaaattcgaaacacgaccctagacgacccgtacgaacggtaccgaccggtccgttgttaagttttggacggtacgagtacttacgttcgttacggtttacccaaaagttccggttaactacgttcgaccggtccgttcggggtaacccgg

SEQ ID NO: 424499 - DNA, 544 bp, Homo sapiens
  misc_feature: GZ8MTXP01DLOQU.44.27.C05.1.454.CMB.2.raw
  modified_base (189)..(189): a, c, t, g, unknown or other
  modified_base (440)..(440): a, c, t, g, unknown or other
  modified_base (447)..(447): a, c, t, g, unknown or other
  modified_base (450)..(450): a, c, t, g, unknown or other
  modified_base (526)..(526): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaaatattcttagtcttaacttgtctcctgtatcaacatcaatccaggtaaagcccccaaaatcatcaatctatgagcctaataaagacggcctcaggggtttcaaatcgcttcacctgctacaacgtccgaacaaacgccgctccctgaacaatctcgtcggctaccgaggcagaggacgaggctagtattattagttgttgctagagtntgtcgcnctntactacttgtcgttacgtaggaaggtcggaacttaggtccacgtacgtagacacgacccgaacgaccccaaccctntcgttacctcttcgtccg

SEQ ID NO: 424500 - DNA, 602 bp, Homo sapiens
  misc_feature: GZ8MTXP01A2DO5.44.27.C05.1.454.CMB.2.raw
  modified_base (266)..(266): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctcnggattcaccttcgataatggaatatgcaggtggtccgcaggctccgaggcgaggggctggagtggggtggcgaggtgtgtcagtttccagtggaaggaaatcgaaaagttctaacgggtgactttcccgggttgacggggtccctattcccacctactctaccagagactaaacgttaccgaacgaacaacagtacgtactacttacgaaatgaacacgacctgacgacctacgacggaccgacggccgttgttaatttggttgcgttagtacttattcgttcgtttacaaacgttcgttaacgtacgttaccgacgtccgttcggggtaacccgg

SEQ ID NO: 424501 - DNA, 588 bp, Homo sapiens
  misc_feature: GZ8MTXP01A1F79.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctctggattcaccttgataatggaatatgcaggtcggtccgcaggctcgaggcgaggggctgggagtgggtaggaggtgtgtctatttccagtgggaaggaaatcgaaaagtctaacgggtgtatttcccggtggacgggcctattccactatctccagacgactaacttaccgagaacacagtcgtactcttactaaatagaaaccagcctagacgaccgtacgacggaccgacggtccgttgttaattttgttgtcgagtactattcgttcgtttacctaaattcggttaacacgttcgaccgtccgttcggggaacccg

SEQ ID NO: 424502 - DNA, 596 bp, Homo sapiens
  misc_feature: GZ8MTXP01DP7GD.44.27.C05.1.454.CMB.2.raw
  modified_base (189)..(189): a, c, t, g, unknown or other
  modified_base (235)..(235): a, c, t, g, unknown or other
  modified_base (369)..(369): a, c, t, g, unknown or other
  modified_base (379)..(379): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatnttcttagtcttaactttgtctcctggtatcaacatcatccaggtaaacgcccccaaactcatcatctatgaggcctaataagaggccctagagggggtttctaaatcgcttcacctgctccaagtccgacaacncggcctcccngacatctcgtcgggctcgaggctggaggacgaggctagtattattattgttgtctcgagtattcgttacgtcgctattctaactttatggttaccgttacgggaaaggttcggggtaacccttaaaggggttcccttaacccggttccgtacgggttaccacggaccccgaacggaccccaaaccccgtctacgttccctaacgttccttaaccccg

SEQ ID NO: 424503 - DNA, 549 bp, Homo sapiens
  misc_feature: GZ8MTXP01AUTK5.44.27.C05.1.454.CMB.2.raw
  modified_base (301)..(301): a, c, t, g, unknown or other
  modified_base (495)..(495): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggagcgtggccccagtaggggggtccctgagactctcctgtgcagcctctggattcaccttcgataattggaatatgcagtgggtccncaggctccaggcgaggggctgggagtgggtggcaggtgtgtcatttccatggagaaatcaaagtctaacgggtgattccggttgagggcccgattccacctatctccagagacaattccgagaacacagtgtctcttacaaatgaacagaccctgacgacctcacggacacgtccgtggttaattttgttgcgngactattcttgttccctaaaattcggttcagttcgaccgtcgttcggggcccgg

SEQ ID NO: 424504 - DNA, 582 bp, Homo sapiens
  misc_feature: GZ8MTXP01D2S6K.44.27.C05.1.454.CMB.2.raw
  modified_base (189)..(189): a, c, t, g, unknown or other
  modified_base (269)..(269): a, c, t, g, unknown or other
  modified_base (381)..(381): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatattcttagtcttaactttgtctcctggtatcaacancatccaggtaaacgcccccaaactcatcatctatgagacctaataagaggtcccctacgtaggggtttctaatcgcttcaccctcgacctccgaacgtcccggaacaaaccnccggccctccctgaaccaatcgtcgtcggctaccgaggctggaggacgaaggcttagtatttaattagttgttgccttaggaagtattcgttctcgtacattctaacttagtcgttacgttacggaagtcgggaacttaggtccgaccgtcgtagggcttgttcgttcgactcgaagaagttcgaaccgttaaggaagggg

SEQ ID NO: 424505 - DNA, 610 bp, Homo sapiens
  misc_feature: GZ8MTXP01DFX18.44.27.C05.1.454.CMB.2.raw
  modified_base (266)..(266): a, c, t, g, unknown or other
  modified_base (301)..(301): a, c, t, g, unknown or other
  modified_base (330)..(330): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccagtagggggtccctgagactctcctgtgcagcctntggattcacttcgataatgaatatgcagtggtccncaggctcgaggcgagggctggaggtgggnggcagggtgtgtctagtttcagtggaagaaatcgaaagtcgtacgggtgaagtttcccggttggacggggtcccgtagttccacctactctaccagaagaacaattccgaagaacacagtagtctacgttactaaatagaacacgcctagacgacctcgacggacgaccggcccgttgttaacgttttggtcgcggtaaggtacttacgttcttacggtttaacctaaaaacgttccgggttactacgtttccggtaaccggttcccggttaaccggggg

SEQ ID NO: 424506 - DNA, 595 bp, Homo sapiens
  misc_feature: GZ8MTXP01DXEJY.44.27.C05.1.454.CMB.2.raw
  modified_base (301)..(301): a, c, t, g, unknown or other
  modified_base (385)..(385): a, c, t, g, unknown or other
  modified_base (524)..(524): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcacttgataatggaatatgcaggtcgggtccnccaggctccagggcggaggggctgggaggtggggtggcagggtgtgctatttccagtggaagaaatcgaaaagtctaacgggtntacgttccggttggacggggtcctagttccacctatctccagacgacgtaacttccgaagaacacgagtcgtacttcttacgaaataggaacacgacctagacgacctacgacggtacctacggtcgtgttaagtttgngtcgagtactattcgttcgtttacctaaattccggttaacacgttccgacgtccggttcggggtaaccccg

SEQ ID NO: 424507 - DNA, 602 bp, Homo sapiens
  misc_feature: GZ8MTXP01CD469.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggcccagtaggggggtccctgagactctcctgtgcagcctctggattcaccttcgataattggaatatgcagtggtccgcaggctccaggcgagggggctgggaggtgggtggcgaggtgtgtcaagtttcccaatgggaaggtaaatcgaaaagttctaacggtgtaagttccggttgagggccgtattccacatctccagacgacaacttccgaagaacacagtgtactcttacaaattaggaactacgacctgaacgacccgttacgaacggtaccgaaccggtccgttggttaactttttggttggaccgttagtaccttattcgttgtttacccaaaagttcggttaacacgtttcgaccgtccgttggggaaccccg

SEQ ID NO: 424508 - DNA, 576 bp, Homo sapiens
  misc_feature: GZ8MTXP01AOP5G.44.27.C05.1.454.CMB.2.raw
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccnccaggctccagggcgagggggctgggagtggggtggcgaggtgtgtcatttccagtggaggaaatcgaaaagtctaacgggtgatttcccggttggaggggccctattccaccatctccagagacaacttccgagaacacagtgtactacttacgaaatagaacacgcctgacgacctacgacgacgacggtccgtgttaattttgttggtcgagtacttattcgttcgtttacctaaatcggttaactattacgacgtccgttgggtaacccgg

SEQ ID NO: 424509 - DNA, 561 bp, Homo sapiens
  misc_feature: GZ8MTXP01BF199.44.27.C05.1.454.CMB.2.raw
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccncaggctccgaggcgagggggctgggagtggggtggcaggtgtgtctatttccagtggagaaatcaaaagtctcggtgattccgttgagggccgattccacatctccagagacaattaccgagaacacagtgtctctacaaatgaacagcctgacgacctacaggaccacggtccgtgttaacttttgttgcgagacttattcgttcgttacctaaaatccggttaactcgttacgacgtccgttcggggtaacccgg

SEQ ID NO: 424510 - DNA, 583 bp, Homo sapiens
  misc_feature: GZ8MTXP01BEW22.44.27.C05.1.454.CMB.2.raw
  modified_base (301)..(301): a, c, t, g, unknown or other
  modified_base (524)..(524): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccnccaggctccgaggcgagggggctgggaggtgggggtggcagggtgtgtctatttccagtgggaacggtaaatcgaaaagttcgtaacgggtgagtttcccggttggacggggccgatttccaccctagtcctccagagacaaattaccgaagaacacgagtcgtactcttacaaatagaacacgcctgacgacctcaggaccacggtccgtggttaattttgngcgagactattcgttgtttaccaaattcggttaactacgtcgacgtccgttggggcccg

SEQ ID NO: 424511 - DNA, 541 bp, Homo sapiens
  misc_feature: GZ8MTXP01AK1BD.44.27.C05.1.454.CMB.2.raw
  modified_base (303)..(303): a, c, t, g, unknown or other
tcagacagtatatacacgaccggtgctcgatttagacgcgatcgaagggtttggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccncaggctccgaggcgagggggctgggagtgggtggcgaggtgtgtcatttccatggagaatcaaagtctaaggtgattccgttgagggccgattcaccatctccagagacaattccgagaacacagtgtctcttacgaaatgaacagcctgacgacctcaggacacggccgtgtaactttgttgcgagtactattcgttgttaccaaatcggttcacttcgacgtccgttggggtcccg

SEQ ID NO: 424512 - DNA, 573 bp, Homo sapiens
  misc_feature: GZ8MTXP01DMW5I.44.27.C05.1.454.CMB.2.raw
  modified_base (302)..(302): a, c, t, g, unknown or other
  modified_base (348)..(348): a, c, t, g, unknown or other
  modified_base (402)..(402): a, c, t, g, unknown or other
  modified_base (440)..(440): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccncaggctccgaggggaaggggctggagtgggtctcgagtctatttanacgtggtgatttcaactatactaacgcaagactccgtgaacgggccattcaccntctaccgagggacaattcccgaaggaactacggtttancttacaaatcgaaacaaccgtgaagacggacgaacgacgacggccgtactattcctgtcgcgaagacaggtcggcgcgtacggagttgttattgttcgtttgacttcggttggggtcccaaggggtaaccccg

SEQ ID NO: 424513 - DNA, 623 bp, Homo sapiens
  misc_feature: GZ8MTXP01A3I9A.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggcccaggtacgggggtccctgagactctcctgtgcagcctctggattcaccttgataattggaatatgcaggtcgggtccgccaggcctccgaggcgagggggctgggaggtggggtggcgaggtgtgtcatttccagtgggaaggaaatcgaaaagttctaacgggtgtaacgtttcccggttaggacggggcccgtatttccacctactcctaccgagacgaactaacttaccgaacgaacacgagtacgtacttacttacaaatacgaaacacgacctgacgacccgtacgacggaccgacggtccgttgttaagttttgttcggtacgagtaacttagttcttcgtttacctaaaagttcggttaactacgttcgaccgtccggttcggggtaacccg

SEQ ID NO: 424514 - DNA, 613 bp, Homo sapiens
  misc_feature: GZ8MTXP01B1LW7.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcaggtcggtccgccaggcctccgaggcggagggggctgggaggtggggtggcgaggtgtgtcatttcagtggaaggaaatcgaaaagtctaacgggtgtaagtttcccgggttagacggggccgtattcccacctatcctaccagacgaactaacttaccgaagaaacactagtgtactacttacgaaatacgaacacgtacctagacgacctacgacgacgtaccggtaccgttgttaagttttggttgtcgaagtacttagttcttcgtttacctaaaagttcggtaactacgttcgttacgtccggttcggggtaacccg

SEQ ID NO: 424515 - DNA, 635 bp, Homo sapiens
  misc_feature: GZ8MTXP01A3LGM.44.27.C05.1.454.CMB.2.raw
  modified_base (285)..(285): a, c, t, g, unknown or other
  modified_base (360)..(360): a, c, t, g, unknown or other
  modified_base (374)..(374): a, c, t, g, unknown or other
  modified_base (383)..(383): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggccnccaggctccagggcgaggggctgggaggtggggtggcgaggtgtgtcatttcagtggagaatcaagtctacggtnattcgtgacggccnttcacatcncagagacaattaccgagaacacagtgtctacttacaaatagaacacgacctagacgaccctacgacggaaccgaccgggtaccgttgttagtttttgtagtacgtaagtaacttaacttcgttaacgtttaaccttaaaaacgttccgggtttactaacgtttccggaaccggttcccggttacgggggaaccccgtaacggggtaaccccgtcgggtacccgttaccccggttccgttccccgtccccggg

SEQ ID NO: 424516 - DNA, 706 bp, Homo sapiens
  misc_feature: GZ8MTXP01C8G0G.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccnccaggctccaggcgagggggctgggagtgggggtggcagggtgtgtcatttccatgggaggaaaatcgaaaaagttctaacgggtgtaacgtttcccgggttaggacgggggccctaagtttcccaaccctacgtccttacccgaaggaacggtaaaccaaagtttaccccgaaggaaaccaaccgtaaagttgtaccttaccttactaaaagttgaaaaccacggacccttaggacggaacccttacgaacgggtaaccgaacccgggtccggttaggttaagttttttcgggttaggtaccgttaaggtaacttacttaccgtttcggttttaaccctaaaaaacgttccgggtttaactaacgtttccggaaccggtcccggttcgggggtaacccccgg

SEQ ID NO: 424517 - DNA, 624 bp, Homo sapiens
  misc_feature: GZ8MTXP01EO8DZ.44.27.C05.1.454.CMB.2.raw
  modified_base (263)..(263): a, c, t, g, unknown or other
  modified_base (299)..(299): a, c, t, g, unknown or other
  modified_base (329)..(329): a, c, t, g, unknown or other
  modified_base (336)..(336): a, c, t, g, unknown or other
  modified_base (370)..(370): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcaccttgataattgaatatgcagtggtccncaggctccgaggcgagggctgggagtgggngcaggtntgtcatttcagtggagaatcaaagtctaacggtntacgttccggtgacgggtcgtattcactatctcagagactaacgttccgaagaacacgtagtcgtactacttacgaaatgaaacacgtcctagacgtacctacgacggtaccgacggtaccgttggtttaagtttttcggacgtaccggttacgtaacgttaacgttcgtttacgttttaaccccgtaaaaagtttcccggtttaacgttaacgttccggacccggttaacccggttccgggggtaaccccggg

SEQ ID NO: 424518 - DNA, 748 bp, Homo sapiens
  misc_feature: GZ8MTXP01A442A.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggattcaccttcgataattggaatatgcgagtgggtccgccaggctccgaggcgagggggctgggaggtggggtggcgagggtgtgtctatttccagtgggaaggaaatcgaaaagttcgtaacgggtgtacgtttcccggttggaacggggtcccgtattcccaccgtactccttacccgagaacgaaccgtaaacgtttacccggaaacggaaaccaaaccgtacgttacggttaccttaaccgtttaaccaaaagttacggaaaaccgtacggtacccttacgggaaaccgtaccccgtacgaaacgggaacccgtaccggggtccccggttaggttttaacgttttttgggttacggtacccggttaaggtacctttaacgttccgtttacggttttaaccccgtaaaaacgttccggggtttaacttaaccggtttacccggttacccgggtcccgggtttccggggggtaaccccggg

SEQ ID NO: 424519 - DNA, 721 bp, Homo sapiens
  misc_feature: GZ8MTXP01C2OK3.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataatggaatatgcagtggtccgccaggctccgagggcgagggggctgggaggtggggtggctagggtgtgtctagtttccgagtagggaaggtaaatcgaaaaggttcgtaacgggtgtaacgtttccggttaggacggggtcccgtaatttcccaaccctaatcctacccgaaggtaacgaaacctaaacgtttaccccggaaagaaaccaaccgtaagtcgttaccttaccttaactaaaacgttcggaaaaccacggtaccctaggaaccgacccgtaacgaacgggtaaccgtaacccgggtcccggttggtttaacgtttttggttcggtaccgttacggtaacgttacttaccgttcggttttaaaccctaaaagtttccgggttccttaacgttccgggttaaccggtcccggttaacgggggtaaccccgg

SEQ ID NO: 424520 - DNA, 587 bp, Homo sapiens
  misc_feature: GZ8MTXP01AHH17.44.27.C05.1.454.CMB.2.raw
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctccgaggcgaggggctgggagtgggtggcaggtgtgtcatttccagtggaaggaaatcgaaaagttctaacgggtgaatttcccggttagacggggcctattcccgacccatcctccgaagacgactaaacgttaccgagaacacgagtgtactcttacaaatcggaacacgacctgacgacctcgacgtcgacggtcgttgttaatttggttgtcgagtactattcttcgtttacctaaagttcggttctacgttccgacgtccgttcggggtaacccgg

SEQ ID NO: 424521 - DNA, 712 bp, Homo sapiens
  misc_feature: GZ8MTXP01COLLN.44.27.C05.1.454.CMB.2.raw
  modified_base (296)..(296): a, c, t, g, unknown or other
  modified_base (337)..(337): a, c, t, g, unknown or other
  modified_base (344)..(344): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcagcctctggattcacttcgataattggaatangcaggtggtccgcaggctccgaggcgagggctggagtgggngcaggtntgtcatttcgatggaagaaatcgaagtcgtagggtgtaagtttcccggttagaacggggtccccgtaatttccgaacctactactaccgaacgaacgtaacgtaaacttacccggaacgaaaccaaccgtaagttacgttacttaccgtttaacctaaaacgttacgaaaccgaacgaccccgttaggaacgaaaccccgttcgtaaacggacccgtaaccggggtccccgtttaaggtttaacgtttttggttacggttccggtaaacggtaacccgttagtttaccttacgggttttaaccctaaaaaagttttcccgggtttacgttacgttacccggtaacccggttccgggttaacccggggg

SEQ ID NO: 424522 - DNA, 769 bp, Homo sapiens
  misc_feature: GZ8MTXP01BG1MU.44.27.C05.1.454.CMB.2.raw
  modified_base (299)..(299): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggcccaggtagggggtccctgagactctcctgtgcagcctctggacttcacttgataatggaatatgcaggtggtccncaggctccgaggcgaggggctgggagtgggtggcgtaggtcgtgtctagtttccgaagttaggggaaggtaaaactcgtaaaaacggttcgttaacggggtattaaaccggtttcccggttaggggaacgggggtaccccgtaatttaccccgaacccgtaacttacccgtacccgtaaaggtaaaccggaaaccctaaaaccgtttacccggaaacggaaaacctaaccgtaaaggttcggttaaccgttacctttaaaccgtaaaagttaacgtaaaccgaacggtaccctaacggtaaccgacccgtaaccgaacgggtaaccgtaccgggtaccgtttcgtttaagtttttcgggttacggtacgttacggtaaccgttacttaccgtttacgtttaacccgtaaaacgttcgggttaaccttacgttccgggttaaccgtcccgggttaacggggtaaccccggg

SEQ ID NO: 424523 - DNA, 621 bp, Homo sapiens
  misc_feature: GZ8MTXP01EGY0B.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcagtcgggtccncaggctccgaggcgaggggctgggagtgggtggcaggtgtgtctagtttccagtggaaggaaatcgaaaagttcgtaacgggtgtaacgtttcccggttaggacggggtcccgatttcccacctattcctaccgagaacgaactaaacttaccgaagaaacaacgagtacgtacttactttacaaattacgaaacacgtaccctagacgaccgtacgaggaccgacggtccgttgttaagttttgttgtcgagtactattcgttcgtttacctaaagttccggttaactacgttccgacgtccgttcggggtaacccgg

SEQ ID NO: 424524 - DNA, 596 bp, Homo sapiens
  misc_feature: GZ8MTXP01CP1IW.44.27.C05.1.454.CMB.2.raw
  modified_base (287)..(287): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccagtaggggggtccctgagactctcctgtgcagcctctggattcaccttcgattaattggaatatgcagtgggccncaggctccaggcgaggggctggagtggggtggcgaggtgtgtcatttcatggaggaaatcaagtctaccggtgtagttccgtgagggccgtattccaccatctcagagacaattccgagaacacagtgtactcttacaaatcaacagcctgacgacctacgaggaccacggtccgtgttagttttgtcgcgtagtactatcttaacgtttacaaagttcggttacgtacgttcgttaccggccgttcgggggcccgtaacgggggtaaccccgtcgggtcccgacccggttccgttcccgttccccggg

SEQ ID NO: 424525 - DNA, 561 bp, Homo sapiens
  misc_feature: GZ8MTXP01BYFCV.44.27.C05.1.454.CMB.2.raw
  modified_base (189)..(189): a, c, t, g, unknown or other
  modified_base (222)..(222): a, c, t, g, unknown or other
  modified_base (266)..(266): a, c, t, g, unknown or other
  modified_base (280)..(280): a, c, t, g, unknown or other
  modified_base (298)..(298): a, c, t, g, unknown or other
  modified_base (363)..(363): a, c, t, g, unknown or other
  modified_base (451)..(451): a, c, t, g, unknown or other
  modified_base (537)..(537): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactgganccagcgtaatattcttagtcttaacttgtctcctgtatcaacancatccaggtaaacnccccaaatcatcatctangagcctaataagacgtccctgtagggtttctaatcgcttcacctcgcctacacgtcccgacaacnccggccctccctgactaatctcgtgggcctccgaggctaggaggtacgaggctagtatttattattgtgctcgagtattgttcgtcgntactctactttatgtacgttggaaggtcgggaaccttaggtccaccgtactaggttccgacgacccgaaacggcccctaaaccccngtcgttcctaaccgttctccccgg

SEQ ID NO: 424526 - DNA, 561 bp, Homo sapiens
  misc_feature: GZ8MTXP01DNORL.44.27.C05.1.454.CMB.2.raw
  modified_base (189)..(189): a, c, t, g, unknown or other
  modified_base (223)..(223): a, c, t, g, unknown or other
  modified_base (310)..(310): a, c, t, g, unknown or other
  modified_base (358)..(358): a, c, t, g, unknown or other
  modified_base (366)..(366): a, c, t, g, unknown or other
  modified_base (422)..(422): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctgtatcaacatcatccagtaaacgccccaaactcatcatctatgagctataagngccctgagggtttctaatcgcttcacctcgcctcaacgtccgacaacncgcctccngacatctcgtcggctcgaggctggagacgaggctgtattattattgtgcttgagtnttgttcgtcgctattactactttatcgttacgttcggaaggttcgggaaccttaaggtccaccgttccgttagggttccgacggttaccccgaaacggccccaaccccgtacttcgttacctaaccttccgtttccccg

SEQ ID NO: 424527 - DNA, 550 bp, Homo sapiens
  misc_feature: GZ8MTXP01AV3F9.44.27.C05.1.454.CMB.2.raw
  modified_base (321)..(321): a, c, t, g, unknown or other
  modified_base (364)..(364): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctctggtatcaacatcatccaggtaaacgcccccaaatcatcatctatgagcctaataagagccctnagggggtttctaatcgcttcacctgcctcaagtccggacaacncggcctccctgacatctctgggctcaggctgagacgagctgattattatgttgcttgagtatgttcgtgcatctacttatgtcttcgggaagtggggtaaccaagggttccaccggttccgtaaggttcccgaggaccccaaagggcccctaaccccgacgttacgttcctaaccttccgttcccg

SEQ ID NO: 424528 - DNA, 548 bp, Homo sapiens
  misc_feature: GZ8MTXP01CYOTD.44.27.C05.1.454.CMB.2.raw
  modified_base (189)..(189): a, c, t, g, unknown or other
  modified_base (223)..(223): a, c, t, g, unknown or other
  modified_base (287)..(287): a, c, t, g, unknown or other
  modified_base (368)..(368): a, c, t, g, unknown or other
  modified_base (386)..(386): a, c, t, g, unknown or other
  modified_base (440)..(440): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatattcttagtcttaactttgtctcctggtatcaacatcatccaaggtaaaacncccccaaatcatcatctatgaggcctaataagaggccctgaggggtttctaatcgcttcacctgctcaagtcccgacaacncgcctccctgacaatctntcggctccaggctgagacgaggctgattatattgtgctgagtagtgttcgtcgnatctacttatgtcttacggaagttcgggaacccaaagggtccaccgtcgtaagggttcacgccccgaacggaccccaacccgactcgttacctaacgttcctttcccg

SEQ ID NO: 424529 - DNA, 606 bp, Homo sapiens
  misc_feature: GZ8MTXP01A3ATT.44.27.C05.1.454.CMB.2.raw
  modified_base (223)..(223): a, c, t, g, unknown or other
  modified_base (234)..(234): a, c, t, g, unknown or other
  modified_base (262)..(262): a, c, t, g, unknown or other
  modified_base (264)..(264): a, c, t, g, unknown or other
  modified_base (370)..(370): a, c, t, g, unknown or other
  modified_base (541)..(541): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatnttctagtcttaacttgctctgtatcaanancatcaggtaaacgccccaaactcatcatctatgaggcctaataagacggccctcgtagggggtttctaaatcgtcttcacctcgctaccgaacgtccggaacaacnccggcctccctgacaatctacgcgggcctcgaggctgacggacgagggctgtatttattattgttgtactgagtattggttcgtgctaattcctaattagtcgttacgttacgggaaggttaacggggaaccgttaaaggggtccacccggtttaccgtacggggttaccncggaccccgaaacgggaccccaaaccccgtaacgtccggttacctaaccttccgtttaacccccg

SEQ ID NO: 424530 - DNA, 609 bp, Homo sapiens
  misc_feature: GZ8MTXP01BGF58.44.27.C05.1.454.CMB.2.raw
  modified_base (190)..(190): a, c, t, g, unknown or other
  modified_base (224)..(224): a, c, t, g, unknown or other
  modified_base (236)..(236): a, c, t, g, unknown or other
  modified_base (285)..(285): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccaaggtaaacnccccaaactcatcatctatgacgtcctaataacgacggtccctagtaggggtttactaatcgtcttcacctcgcctacaacgtccggaacaacgccgcctccctgactactctcgtcggctcgaggctggagacgagctagtattattagttgttgtctgtagtattcgttcgcgctatctactttagtcgttacgttacgggtaacggtcggggtaaacccttaagggttcccttacccggttaccggtacgggttaccgaccggaccccgtaaacggacccccaaacccgtacgtcgttacctaaccgtttcccgttccccg

SEQ ID NO: 424531 - DNA, 583 bp, Homo sapiens
  misc_feature: GZ8MTXP01DEUSY.44.27.C05.1.454.CMB.2.raw
  modified_base (189)..(189): a, c, t, g, unknown or other
  modified_base (222)..(222): a, c, t, g, unknown or other
  modified_base (307)..(307): a, c, t, g, unknown or other
  modified_base (354)..(354): a, c, t, g, unknown or other
  modified_base (373)..(373): a, c, t, g, unknown or other
  modified_base (395)..(395): a, c, t, g, unknown or other
  modified_base (439)..(439): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcactgganccagcgtaatattcttagtcttaacttgtctctgtatcaacatcatccaaggtaaacgcccccaaatcatcatctatgagcctanaagagcctcgagggttcaatcgcttcacctgctcaagtccgacaacncgcctccctagacatctcngggctcaggctagacgagcgtntagtattattagttgtctccgtaggtagttagtttcgtcgtacncttactacttaacttgttcgtttacggtaacggttagggtaaccgtaaacggttaccgtacccgttaccgtaccggttgacccgaccgaacccgaacccgaaccctaaccctaggtccttacttaacccttcgtttaacccccg

SEQ ID NO: 424532 - DNA, 454 bp, Homo sapiens
  misc_feature: GZ8MTXP01DEAMG.44.27.C05.1.454.CMB.2.raw
  modified_base (123)..(123): a, c, t, g, unknown or other
  modified_base (332)..(332): a, c, t, g, unknown or other
  modified_base (407)..(407): a, c, t, g, unknown or other
  modified_base (421)..(421): a, c, t, g, unknown or other
  modified_base (440)..(454): a, c, t, g, unknown or other
tcagacagtatatacacgaccggtgctcgatttagacgcgatcgaagggtttgggacagagtcaccattaccgcggacgaatccacgagtacagcctacatggagctgagcgaggcgtgaagntctagaagacacggccatctatttctgtgcgagagccctcgtcaactttcatacgtccctctcatacgtcccacacatggaaatttggttcgacccctggggccagggaaccctggtccaccgtctcctcagtccttacccaacccgaacggggcccacttccgggtcccttccccccgtggcccgtcccctggcctcccgagggaccnccacctccgagcgccacgcggccggccgtggctcgcgtggtacgaacgtacttacttacctatactacgtgtcgnggacgggcggtcgnggacgaacggcgacagtgnnnnnnnnnnnnnnn

SEQ ID NO: 424533 - DNA, 615 bp, Homo sapiens
  misc_feature: GZ8MTXP01BEETQ.44.27.C05.1.454.CMB.2.raw
  modified_base (382)..(382): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggccgcaggctccgaggcgaggggctggagtggggtggcaggtgtgtcatttcagtggagaaatcaagtctacggtgattccgtgagggccattcacatcncagacgacatccgagaacacagtgtctacttacaaatcgaacacgcctagacgaccgtacgaggaccacgggtccgtgttattttggtcgtccgtaagtacttactcgttaacgtttaacccttaaaagttccggttactaacgtttccgaaccggttccggttacgggggtaacccgaacgggggtaaccccgttgggtacccgttacccggttccgttccccggtccccgg

SEQ ID NO: 424534 - DNA, 590 bp, Homo sapiens
  misc_feature: GZ8MTXP01ELHAM.44.27.C05.1.454.CMB.2.raw
  modified_base (283)..(283): a, c, t, g, unknown or other
  modified_base (296)..(296): a, c, t, g, unknown or other
  modified_base (366)..(366): a, c, t, g, unknown or other
  modified_base (454)..(454): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctctgtatcaacatcatccaggtaaacncccccaaatcatnatctatgagctataagagccctgtagggtttctaatcgcttcacctcgcctccgaagtcccggaacaacnccggccctccctgactaactctctcgggcctccgaggctggaggacgaggtctagtattattattgtgtctagagtattcgttcgtcncacttctaactttatcgttacgttacgggaaggttcgggaaccttaaacgggtccttacccgttaccgtagggttaccgacggaccccaaacgggccccaaaccccgtacgtcgttacctaaccgttccttccccg

SEQ ID NO: 424535 - DNA, 606 bp, Homo sapiens
  misc_feature: GZ8MTXP01EQ8TP.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtcgggtccgccaggctccgagggcggagggggctgggaggtggggtggcagggtgtgtcatttccagtgggaagaaatcgaaaagttcgtaacgggtgtaagtttcccggttggacggggtcccgtaatttccaccgtatcctaccagaacgaactaaacttaccgaagtaacacagtcgtactacttacaaattgaaacacgcctagacgacctacgaggacgacggtccgttgttaagttttgttgcgagtacttattcgttcgtttactaaattcgttaactagttcgacgtccgttcggggaaccg

SEQ ID NO: 424536 - DNA, 605 bp, Homo sapiens
  misc_feature: GZ8MTXP01EN9RH.44.27.C05.1.454.CMB.2.raw
  modified_base (160)..(160): a, c, t, g, unknown or other
  modified_base (298)..(298): a, c, t, g, unknown or other
  modified_base (335)..(335): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtggttttccncgttgccctcttaagaggtgtcatgtgtcaggtgcaattcgtggagtctgggggagcgtggccccaggtagggggtccctgagactctcctgtgcagcctctggattcaccttgataattggaatatgcagtggtccncaggctccgaggcgagggctggagtgggtgcgaggtntgtcatttccagtggaaggaaatcgaaaagttctaacgggtgtaacgttcccggttgacggggtccctatttcccacctatctccagagaactaacgttaccgaagaacacgtagtctactaccttaacgaactacgaacacgcgtacgacgaccgtacgacgtaccgtacggtcgttgttaagtttgttgtacgttagtacttacgttcgttacgtttaccgtaaagttcgttaactcgttaccggaccggtccggttccgggtaaccg

SEQ ID NO: 424537 - DNA, 545 bp, Homo sapiens
  misc_feature: GZ8MTXP01AZ34B.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (266)..(266): a, c, t, g, unknown or other
  modified_base (280)..(280): a, c, t, g, unknown or other
  modified_base (366)..(366): a, c, t, g, unknown or other
  modified_base (383)..(383): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaattgtctctggtatcaacancatccaggtaaacnccccaaactcatcatctatgagctaataagacgccctgtaggggtttctaatcgtcttcacctgcctaccgaagtcccgaacaacncggcctccctgacatcnctcgggctcgaggcgtagagacgaggctagtatttattattgtgtctgagtattgttcgtgctatctacttagttgtcttacgggaaggtggaaccaaaggtcaccgtccgtagttccgacgacccgaacggcccaaccctagcgttacaaccgttctcccg

SEQ ID NO: 424538 - DNA, 614 bp, Homo sapiens
  misc_feature: GZ8MTXP01EFFZS.44.27.C05.1.454.CMB.2.raw
  modified_base (224)..(224): a, c, t, g, unknown or other
  modified_base (235)..(235): a, c, t, g, unknown or other
  modified_base (486)..(486): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactcccctcacccaggacacagggtcctgggcccagtctgccctgactcagcctgcctccgtgtctgggtcgcctggacagtcggtcaccatctcctgcactggacnccagcgtaatnttcttagtctttaacttgtctcgtgtatcaacatacactaccaagtaaaccgaccccaaactcatcatctatgacggtacctaagtaagacggtcccttacggtacggggttttactaaacgttccgtccttacaccgttcccgtaccctaccgtaaacggtacccggacccgaaaacccgaacccggtccccgtacccgtacgtaaacctaaccgttacgtaccgtacggtaccgtaccgtacggtacgnacgtacgacggacggtacgtacgttacgttagtttaagtttagtttacgttcgttcgtacgttacgttcgttcgttcgttccgtacgtaacttacttacgttacgtttaacggttaacggttaacggg

SEQ ID NO: 424539 - DNA, 647 bp, Homo sapiens
  misc_feature: GZ8MTXP01D0I5Q.44.27.C05.1.454.CMB.2.raw
  modified_base (264)..(264): a, c, t, g, unknown or other
  modified_base (304)..(304): a, c, t, g, unknown or other
  modified_base (393)..(393): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctntggacttcaccttcgataattggaatatgcaggtggtccncaggctccgaggcgaggggctgggaggtggggtggcgaggttgtgtctagtttccagttggaaggtaaatcgaaaagttctaacgggtntaacgtttcccggttaggacggggtccgtattccacctatcctaccgagaacgaactaaacgttaccgaagaaacaacgtagtcgtacttacttaactaaagtacgaaacaacgtaccgtacgacgtacccgtacgaacggaccgtaaccgggtccgttagtttaacgttttggttcgtacgttacgtaacttattcgttacgttaaccgtaaaattcgttaactacgttcgacggtccgttcgggtaacccgg

SEQ ID NO: 424540 - DNA, 600 bp, Homo sapiens
  misc_feature: GZ8MTXP01BCZ09.44.27.C05.1.454.CMB.2.raw
  modified_base (272)..(272): a, c, t, g, unknown or other
  modified_base (365)..(365): a, c, t, g, unknown or other
  modified_base (456)..(456): a, c, t, g, unknown or other
  modified_base (477)..(477): a, c, t, g, unknown or other
tcagacagtatatacacgaccggtgctcgatttagacgcgatcgaagggtttggggagccctgggagacgagcccagcactggaagtcgcccggtgtttccactcggtgatcatcactgaacacagaggactcaccatggagtttgggctgagcttgggtttttcctcgttgccctcgttaagaggtgtcatgtgtcaggtgcaattcgtggagtcgtgggggagcgtggccccgaggtagggggtcccctgagactctcctgtgcagcctntggacttcaccttcgattaattggaatagtgcaggtcgggtcccgcgagggcctaccgagggcgagggggctgggagtggggtcggcagggtntggtactatttcgagtggaaggaatcgaagtgtacggtgagttccgtgagggtccaattcaccatctaccagacgacaacttaccggaaanaacacgtagtctactacgtanaaatacgacgacgacgcgacgaccgacgtacgacgaccgtcgtaagttagtttgtcgcgtacgtacttacgttcttacgttaactaacgtaacgttacgtacgttacgtccgttccggtcggg

SEQ ID NO: 424541 - DNA, 731 bp, Homo sapiens
  misc_feature: GZ8MTXP01DJWFM.44.27.C05.1.454.CMB.2.raw
tcagacagtatatacacgaccggtgctcgatttagacgcgatcgaagggtttgggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggacttcaccttcgataattggaatatgcagtcggtccgcaggctccgaggcgaggggctgggagtgggtggcaggtgtgtcatttccagttagggaggtaaatccgaaaaggttcctaacgggtgtaacgtttcccgggttaggaacgggggtcccgtaatttcccgaccctaacgtcctaccagaacgaacaaagtttccgaaagaaaccaacctaaagttcgttacttacctttaactaaaacgttacggaaaccacggaccttacgaacgtacccgtaaccgtaacgggaaccgtacccgggtcccggtttaggtttaacgttttttgggttacggtacccggttaaggttaaccgttactttaccgtttccggttttaaacccttaaaaacgtttccgggtttaaccgttacgtttacccgggttaacccggttccccggttaaccgggggtaacccccgggg

SEQ ID NO: 424542 - DNA, 605 bp, Homo sapiens
  misc_feature: GZ8MTXP01A8WH1.44.27.C05.1.454.CMB.2.raw
  modified_base (304)..(304): a, c, t, g, unknown or other
  modified_base (340)..(340): a, c, t, g, unknown or other
  modified_base (446)..(446): a, c, t, g, unknown or other
  modified_base (525)..(525): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtagggggtccctgacgactctcctgtgcagcctctggattcaccttcgataattggaatatgcaggtgggtccnccaggcctccgaggcggagggggctgggagtggggnggcgtaggtgtgtctatttcgagtggaaggaatcgaaagttctaacgggtgtagttcccggtgacggggcctattcacctatctaccagagactaacgttccgaanaacactagtcgtactcttacaaatagaacacgacctagacgacctacgacgtaccgacggtccgttgttaagttttcgngtacgagtactacttcgttcgtttaccgtaaaagttcggttaactacgtccggaccggtccggttcgggggtaaccccgg

SEQ ID NO: 424543 - DNA, 629 bp, Homo sapiens
  misc_feature: GZ8MTXP01C925Z.44.27.C05.1.454.CMB.2.raw
  modified_base (330)..(330): a, c, t, g, unknown or other
  modified_base (394)..(394): a, c, t, g, unknown or other
  modified_base (590)..(590): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgcaggctccaggcgaggggctggagtgggtggcaggtgtgtcatttcatggaggaaatcaagtctacggtgattccgttgaggccgattcaccatctccagagacaattccgagaacanagtgtctcttcaaatcgaacagcctagacgaaccctcaaggacacgggccgttgtatttttggngcgtagacttatcttgtttacctaaaattcggttactagtttccgacgccgtcggggacccgtacgggtaacccggttcggtccgtacccgttccttcccgtccgggtcccttcccgaacccgtaacggggtccccacgtcccggttcccttcccccgttcgggcccgtccccgttcgcccttccgacggcgaccncccgtaccgaacgacgacaccgaacggccgggtccccgg

SEQ ID NO: 424544 - DNA, 604 bp, Homo sapiens
  misc_feature: GZ8MTXP01A3CXF.44.27.C05.1.454.CMB.2.raw
  modified_base (263)..(263): a, c, t, g, unknown or other
  modified_base (301)..(301): a, c, t, g, unknown or other
  modified_base (533)..(533): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntggattcaccttgataattggaatatgcaggtggtccncaggctccgaggcgagggggctgggagtgggtggctaggtgtgtcatttccgagtgggaaggaaatcgaaaagtctaacgggtgtacgtttcccgggtggacggggcccgtaattccgaccactcctaccgagaacgactaaacttccgaagaaccacagtcgtacttacttacaaatcgaaacacgtcctagagaccgtacgacggtaccgacggtccgtgttaattttgnggtcgagtactattcgttgtttacctaaaagttcggttaactacgttcgacgtccgttcggggtaacccgg

SEQ ID NO: 424545 - DNA, 696 bp, Homo sapiens
  misc_feature: GZ8MTXP01AJW98.44.27.C05.1.454.CMB.2.raw
  modified_base (263)..(263): a, c, t, g, unknown or other
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctntggattcaccttgataattggaatatgcaggtgggtccncaggctccgagggcgagggggctgggaggtggggtggcgagggttgtagtcgtattttccgagtgggaaggaaaatcgaaaaggttccgtaacggtgtaacgtttcccggttggacggggtcctattaccaccctactccgtacccgaaggtaacgaactaaacgttaccgaacgaaaccaacgtacgttcgttaccttacttacctaaaagttacggaaacctacgtaccccgtaggaacgtacccgtacggaacggtaaccgaccgggtccgttgttaagttttggttcgtaccgttagtaaccgttaacttccgtttacgtttaacccgtaaaacgtttcggttaaccgtacgttacccggttaccggtcccggttcgggggtaaccccgg

SEQ ID NO: 424546 - DNA, 619 bp, Homo sapiens
  misc_feature: GZ8MTXP01D4BG0.44.27.C05.1.454.CMB.2.raw
  modified_base (263)..(263): a, c, t, g, unknown or other
  modified_base (300)..(300): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcaccttcgataatggaatatgcagtggtccncaggctccgaggcgaggggctgggagtggggtggcgaggtgtgtctatttccagtggaaggaaatcgaaaagttctaacgggtgtaacgtttcccggttaggacggggtcccgtaatttcccaccctaactcctacccgaagaacgaactaaacgttccgaagaacacacgtgtactacttaccggaaatacgaaacacggacctgacgacctacgacgacacgtaccgttgttaatttgttgtcgagtacttacttcgttcgtttacctaaaagttcggttaactacgttacgaccgtccggttcggggtaaccccgg

SEQ ID NO: 424547 - DNA, 569 bp, Homo sapiens
  misc_feature: GZ8MTXP01ETC3Q.44.27.C05.1.454.CMB.2.raw
  modified_base (264)..(264): a, c, t, g, unknown or other
  modified_base (281)..(281): a, c, t, g, unknown or other
  modified_base (290)..(290): a, c, t, g, unknown or other
  modified_base (365)..(365): a, c, t, g, unknown or other
  modified_base (500)..(500): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtagggggtccctgagactctctgtgcagcctngatcacttgatatgatngcagtggcncagctcgaggcgagggctgggagtgggtgcgaggtgtgctatttcagtaggaagtaatcgaaagtcgtaacggtnagtttccgtaggacgggccgtattcacatctacgagacgaacgtaacttaccgaagacactacgtgtactcttacaaagttacgaaacacgtacctgacgactacgacggaccgacggtccgtgttaagttttgngtacgagtaccttaattcgttgtttaaccaaagtcggttaacagttcgacgtccgttcggggtaacccg

SEQ ID NO: 424548 - DNA, 592 bp, Homo sapiens
  misc_feature: GZ8MTXP01C4KAG.44.27.C05.1.454.CMB.2.raw
  modified_base (189)..(189): a, c, t, g, unknown or other
  modified_base (223)..(223): a, c, t, g, unknown or other
  modified_base (270)..(270): a, c, t, g, unknown or other
  modified_base (372)..(372): a, c, t, g, unknown or other
  modified_base (410)..(410): a, c, t, g, unknown or other
  modified_base (422)..(422): a, c, t, g, unknown or other
  modified_base (457)..(457): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatattcttagtcttaatttgctcctggtatcaaacancatccaaggtaaacgacccccaaactcatcatctatgaggcctaataagagccctgaggggtttctaaatcgcttcacctgctccaaagtccggaacaaccncggccctccctagactaatctctcgggactccgaggcngaggacgaggtntgaatttattagttgttgctgagtattcgtcgtcnctatctaactttagtcgttcgttacggaagttcgggaaccttaaagggttccaccgtaccgtaacgggttccaacgaccccgaaacgggtccccaaaccccccgtatcgttacctaaccgttccgtttaaccccg

SEQ ID NO: 424549 - DNA, 720 bp, Homo sapiens
  misc_feature: GZ8MTXP01A5VHD.44.27.C05.1.454.CMB.2.raw
  modified_base (454)..(454): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccaggcgaggggctggagtgggtgcaggtgtgtctattcagtggaagaaatcgaagtcgtacggtgtactttccggtaggacgggtccgtattccaaccattcctaccgaaggacgaacctaaacgtttcccgaagaaacccacgtaggttcgttaccttacttaacaaaatccggaaacacgtccctagaccaaccctacgaacggaccaccgggtccgttagtttattttggngacgtactacttattcgttacgtttaaccaaagttccggttactacgttccgaccgccggtacggggacccgaacgggtacccgtcggtcctacccgttcctcccgtcccggcccttacccgaacccggtaaccgggtcccctacggttccccggttccccttcccccggtgggttccccgtccccgttcgccccgttacccgaacgggccgttacccgaaccccgtccggaacgaccgaccgaaccgcgggttcccggtcccggg

SEQ ID NO: 424550 - DNA, 548 bp, Homo sapiens
  misc_feature: GZ8MTXP01AN3LW.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (284)..(284): a, c, t, g, unknown or other
  modified_base (363)..(363): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaaatnttcttagtcttaactttgtctcctggtatcaacatcatccaggtaaacncccccaaatcatcatctatgagcctataagagccctgaggggtttctaatcgcttcacctgctccaagtccggacaacncggcctccctgacaatctctgggctcaggctgaggacgaggctgattattattgttgctcgagtattgttcgtcgcattcactttatgttcttcgggaagttgggaaccttaagggtccaccggtccgtaaggttccgacgaccccaacgggccccaaccccgctcgttcaaccttcgttccccg

SEQ ID NO: 424551 - DNA, 609 bp, Homo sapiens
  misc_feature: GZ8MTXP01EIAQK.44.27.C05.1.454.CMB.2.raw
  modified_base (286)..(286): a, c, t, g, unknown or other
  modified_base (296)..(296): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtagggggtccctgagactctcctgtgcagcctctggattcacttgataatggaatngcagtggccncaggctcaggcgagggctgggagtgggtggcgaggtgtgtctagtttccagtggaagaaatcaaaagtctaacggtgtacgttcccggttggacggggtccgatttcccaccatctccagacgaactaacttccgaagaaaccacgtagtcgttacttaccttaacgaaactacggaaacctacgaccgtgaacgtacctaccgacggtaccaccgggtccggttgttaagttttgttggtaccgttagtacctattcgttagtttacctaaagttcgttaactacgttcgaccgtccggttgggaaccccgg

SEQ ID NO: 424552 - DNA, 668 bp, Homo sapiens
  misc_feature: GZ8MTXP01DU4R5.44.27.C05.1.454.CMB.2.raw
  modified_base (161)..(161): a, c, t, g, unknown or other
  modified_base (263)..(263): a, c, t, g, unknown or other
  modified_base (298)..(298): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggttttccncgttgccctcttaagaggtgtcatgtgtcaggtgcaattcgtggagtcgtgggggagcgtggccccaggtacgggggtccctgagactctctgtgcagcctntggatcacctgataatggaatatgcaggtcggtcncaggctccagggccggaggggctgggaggtggggtggcgtaggtgtgtctatttccgagttagggaagtaaatcgtaaaagttcgtaacgggtgtaacgtttcccgggttaggacggggtacccgtattacccacctatcctaccgaagacgaactaaacgttaccgaacgtaaacacgtagtacgttactacttaactaaaacgttagaaaccgaccggtacctacgaaccggacccttaacgaacgggaccgtaaccgggtccgtttggtttaacgttttggttacggtacgttacgtaagttacttacgtttcgttaacctaaacgttcggttctacgttacggaccgtccggttcgggtaacccgg

SEQ ID NO: 424553 - DNA, 588 bp, Homo sapiens
  misc_feature: GZ8MTXP01AMH9O.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (370)..(370): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttctagtcttattgtctctgtatcaacatcatccaaggtaaacgcccccaaactcatcatctatgagcctaataagacggccctcgtaggggtttctaaattcgcttcacctcgcctccaacgtccggaacaaccnccggccctccctagacaatctctcgggcctcgaggctggacggacgaggctaggtatttattattgtgtctacgagtagttcgttcgtcgctaattctaactttatcgtcgttacggaaggttcgggaaccttaagggtccacccggttccgtacggttccgacggaccccgtaacggaccccaaccccgtactcgttaccaaccgttccgttccccg

SEQ ID NO: 424554 - DNA, 619 bp, Homo sapiens
  misc_feature: GZ8MTXP01EHG2G.44.27.C05.1.454.CMB.2.raw
  modified_base (389)..(389): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggacttcaccttcgataattggaatatgcaggtcggtccgccaggcctcgagggcgagggggctgggaggtgggtggcgaggtgtgtctatttccgagtggaggaaatcgaaagttctaacgggtntagtttccggtggacgggtccgtattccacctagtcctaccgagacgaactaaactaccgtaagaacaacgagtcgttacctacttaacgaaatacgaaacacgacctgacgtaccgtacgacgtaccgacggtccgttagttcttttgcgtacgttagtacttacgttcgttacgttaacctaaagttcgttaactacgttccggacgtccggttcggggtaaccccgg

SEQ ID NO: 424555 - DNA, 629 bp, Homo sapiens
  misc_feature: GZ8MTXP01DEZ5H.44.27.C05.1.454.CMB.2.raw
  modified_base (263)..(263): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctntggattcaccttcgataatggaatatgcagtggtccgcaggctccgaggcgaggggctgggagtgggtggcaggttgtgtcatttccagtaggaggaaatcaaaagttctaacgggtgtactttcccggttggacgggccgtattccaccatctccagagaacaattaccgagaacacagtgtactcttacaaatcggtaaacacgacctagacgtaccctcgacggaccgaccggtccgttggtttaactttttggttcggtacggttaacgtaacgttacttacgtttcgttttaaccctaaaacggtttccgggtttaactaacgttccggttaaccggtcccggttcgggggtaaccccggg

SEQ ID NO: 424556 - DNA, 766 bp, Homo sapiens
  misc_feature: GZ8MTXP01DDGGQ.44.27.C05.1.454.CMB.2.raw
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctctggattcaccttgataattggaatatgcaggtcgggtccnccgaggcctccgagggcggagggggctgggggaggtgggggtggcgtagggttgtgtctagtttcccgaaggttgggaaggtaaactcgtaaaagttccgtaacggtagtacgtttcccgggttagggacggggcccgtaattcccaaccctattaccctacccgaagaacgtaaacctaaacgtttacccggaaagtaaaccgtacgtaagttcgttaccttacttaaacggtaaaacgttacggaaaacctacggtacccttaggaacccggtaacccgttacggaaccggggtaaaccgtacccggggttcccgtttaggtttaaaggtttttcggacgggtaccgttaaacggttaaccttacgtttaccgtttacgttttaaacccgtaaaacgtttcccgggttaacttaaccggtttccggaaccggtccccggggttaacggggtaaccccggg

SEQ ID NO: 424557 - DNA, 577 bp, Homo sapiens
  misc_feature: GZ8MTXP01BIRPR.44.27.C05.1.454.CMB.2.raw
  modified_base (343)..(343): a, c, t, g, unknown or other
  modified_base (398)..(398): a, c, t, g, unknown or other
  modified_base (545)..(545): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcagggtgtgtcatttcatggaggaaatcaagtcacggtgattccgtgaggccattcacatctccagagacaattccgaagaacacagttgtctcttanaaatcgaaacagccctgacgaaccctcaagggacacgggtccttagttattttgngcgagactatctgttaccaaagttcggttatattcgacgcgtcgggccgacgggaaccgtcggtccaccgtctcccgtccgccctccgaaccgacggcccagtccggtccttcccccgtggcccgtcccgttcgacctcccgaggcnccaaccctcgaacgacgcacgtcgccggcccg

SEQ ID NO: 424558 - DNA, 549 bp, Homo sapiens
  misc_feature: GZ8MTXP01CLXLH.44.27.C05.1.454.CMB.2.raw
  modified_base (335)..(335): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagccagcctccgtgtctgggtcacctggacagtcgatcaccatctcctgcattggaaccagcagtgacattggtgttaataactatgtctctggtaccaacaacaccaggcaaacgcccccaaatcatgattcatgatgtcagtaatcggcctcgagggtttctggtcnccttctctggctcgaaagtctggcaacgacggcctcctgaccatctctgggctccgaggtctaggaggacgaggctgtactattactgggcagctacgaataataaaagagacaactacttgttaactacgttcgggacgggaaggtacccaaaggtcctggacccgttcttacggtcacgcccaacgggccttaccgcccccgttggtaaccc

SEQ ID NO: 424559 - DNA, 741 bp, Homo sapiens
  misc_feature: GZ8MTXP01A0CE2.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctctggattcacttcgataatggaatatgcaggtcgggtccgccgaggcctccgagggcggaggggcgtgggaggtggggtggcgtaggtgtgtctatttcgagtggaagtaatacgaagtctagggtgtacgttccggtagggacgggtccgtattccgaacctacttaccgtaccgaacggaacgtaaaccgtaaacgtttacccggaaacgtaaaccgtaacgtacggttacggttaccttaccggtttaacgtaaaacgttaacggaaaccgtaccggtaaccccgttacgggaaccgtaaaccccgttaccggtaaccggggtaacccgtaccggggttcccggttaaggttttaaggtttttcgggtacggttacgtaacggttaacttacgttccgtttacgtttaacccgtaaaagtttccgggttacgtaccgttaccggtaaccggttcccgggttaacccggggg

SEQ ID NO: 424560 - DNA, 614 bp, Homo sapiens
  misc_feature: GZ8MTXP01C62EY.44.27.C05.1.454.CMB.2.raw
  modified_base (544)..(544): a, c, t, g, unknown or other
  modified_base (551)..(551): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtggggggaggcgtggcccccgaggtacggggggtccctgagactctcctgtgcagcctctggattcaccttcgataattggaatatgcagtgggtccgccaggctccagggcgagggggctgggaggtgggggtggcgaggtgtgtcatttccatggagaaatcaaaagttctaacgggtgtaatttcccgggttaggacggggtcccgtattcccgaacccatcctacccgaagaacgtaaccaaagttacccgaaagaaaccacgagtcgtaccttacttacaaaagttgaaacacgcctagacgacctacgacgtacgacggccgttagttnttttggngcgagtactattcgttcgtttaccaaattcggttcacgttcgaccgtccgttcggggaacccg

SEQ ID NO: 424561 - DNA, 538 bp, Homo sapiens
  misc_feature: GZ8MTXP01DKOW6.44.27.C05.1.454.CMB.2.raw
  modified_base (224)..(224): a, c, t, g, unknown or other
  modified_base (411)..(411): a, c, t, g, unknown or other
  modified_base (457)..(457): a, c, t, g, unknown or other
  modified_base (522)..(522): a, c, t, g, unknown or other
  modified_base (524)..(524): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcatgcctccgtgtctgggtcgcctggacagtcggtcaccatctcctgcactgganccagcgtaatattcttagtcttaactttgtctcctggtatcaacatcatccaaggtaaacgcccccaaactcatcatctatgaggctataagacggccctcgtagggtttctaatcgcttccactcgcctccaagtcccgacaacgaccgccctccctgacaatctcgtggctcgagctgaggacgngctgtattattattgtgctacgagtattgtcgtcgctatctaattntgtcgttagggaagtcgggactaggttcctaccgtcttacggttcacgcccaacggcccaacccncncgtccaacttcccg

SEQ ID NO: 424562 - DNA, 712 bp, Homo sapiens
  misc_feature: GZ8MTXP01B1TNR.44.27.C05.1.454.CMB.2.raw
  modified_base (266)..(266): a, c, t, g, unknown or other
  modified_base (292)..(292): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcgactcctgngtctctactgaatagtagtatagcgngtaggtcggtccgacgacggtccgtaccggagggacgggacggggtcgtaggggtagggtgggggtggacggtagggttgtcgtacttagttacgaggtagggaaagtaactacgtaaacgttccggtggtagttaccggtttcggtagggacgggtaccgtactacccgactacgtccctaacgacgaacgtaactaaaccgttaccggaaactaaccgacgtacgttcttacttaccgtaaataaagtaacgaacgccgtccgaagaccgtaccgtaggaacggtaccgtccggttacggttgttttaacgttttcggacggtacgttacgttaacttagttaccgtttacgttaaaccgttaagttccggttaacttacggtccggttacccgtccggggttaaccgggtaacccgg

SEQ ID NO: 424563 - DNA, 754 bp, Homo sapiens
  misc_feature: GZ8MTXP01AUIRO.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggattcaccttcgataattggaatatgcaggtgggtccgccaggcctccgagggcgagggggctgggaggtggggtggcgagggtgtggtctatttccgatgggaaggtaaatcgaaaagttccgttaacgggtgtaacgtttcccgggttaggacggggtcccgtaatttcccacccgtatccgtacccaaggaacgaacctaaacgtttacccggaaaggtaaacccaacgtaacgttacggttacctttaccgtttaaccaaaagtttacggaaaaccgtaaccggtacccgttacggaaccggtaaccccgttaccgaaccgggaacccgtacccgggtacccggtttaggtttaacgttttttgggttacggtacccggttagtaacccgtttaagttaccgtttacgggttttaaccctaaaagtttccgggtttaactacgtttacccgggttaaccggtcccggttcgggggtaaccccgg

SEQ ID NO: 424564 - DNA, 577 bp, Homo sapiens
  misc_feature: GZ8MTXP01BIG3I.44.27.C05.1.454.CMB.2.raw
  modified_base (361)..(361): a, c, t, g, unknown or other
  modified_base (478)..(478): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttgataattggaatatgcagtgggccgcaggctccgaggcgaggggctggaggtggggtggcgaggtgtgtctatttcattgggagaaatcaagtctacggtnattccggtgagggccattcacatctccagacgacaattaccgagaacaacagtcgtctacttacaaatagaaacacgacctagacgacctacgaggaccacggccgtgttattttgngtcgtagtactatcgtaagtttaccaaagttcggttactagttcgaccgttcgttcggggcgtacgggaacccgtcggcaccgtcgttcccgtcccggg

SEQ ID NO: 424565 - DNA, 714 bp, Homo sapiens
  misc_feature: GZ8MTXP01DB3HK.44.27.C05.1.454.CMB.2.raw
  modified_base (306)..(306): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtaggggggtccctggagactctcctgtgcagcctctggattcaccttcgataattggaatatgcaggtggccnccaggctccgaggcgaggggctgggaggtcgggtggcgaggttgtgtctagtttcccagttagggaaggaaatccgaaaaggttcctaacggggtagtaacgtttcccgggttaggaacggggtcccgtaaactttcccaaccgtatcctacccgaaagacgaaactaaacgttcccgaaggtaaaccaacgaagtcgttacttaccctttaaacgaaaacgttacgaaacgtacgtaccgtaggaaccgtacccgtacgaacgggtacccgtaccgggttccgttaggttttaagttttcggttacggtacgttaacgttaacgttacgtttacgtttacgtttaaaccgtaaaacgttcgttaacgttacgttaccggaccggtcccgggttaacggggtaacccg

SEQ ID NO: 424566 - DNA, 715 bp, Homo sapiens
  misc_feature: GZ8MTXP01CR8KP.44.27.C05.1.454.CMB.2.raw
tcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggagaatcaagtctacggtgattccgtgaggccattcaccatctcagagacaattccgagaacacagtgtctcttacaaatgaacagcctagacgacctacaggacacggccgtgttattttgtgcgagacttatctgtttaccaaaattcggttacacgtttacccgaccggtccgtcgggggacccaacggggtaaacccctggtccacccgtctcccgtcgcccctccaccgaaacgggcccctacgtcccggttcccttcccccgtcggcccgtccccgtcgtaccctccgaacgggacgacccgacccgttacccgggaacggacggccgaaccgaaccgggcccgggtcccccggtgggggtcccgtccggccccgttacgggtacccgtaaaacgggtcccttaaaccctttccccgttaaattaacgttaccgttaacgggtcctttaggggacgggttcccgggggtaacttacggggccggtaaaacggggccgttaaccgtaacgaaggtg

SEQ ID NO: 424567 - DNA, 550 bp, Homo sapiens
  misc_feature: GZ8MTXP01BDIZP.44.27.C05.1.454.CMB.2.raw
  modified_base (189)..(189): a, c, t, g, unknown or other
  modified_base (223)..(223): a, c, t, g, unknown or other
  modified_base (236)..(236): a, c, t, g, unknown or other
  modified_base (322)..(322): a, c, t, g, unknown or other
  modified_base (386)..(386): a, c, t, g, unknown or other
  modified_base (440)..(440): a, c, t, g, unknown or other
  modified_base (450)..(450): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatnttcttagtcttaactttgctcctggtatcaacatcatccaggtaaacgccccaaactcatcatctatgaggcctataagagccctntaggggtttctaatcgcttcacctgcctccgaagtccggacaacgcggccctccctgacaatcnctgggctccaggctggagacgaggctgatttatattgtgctcagatgttcgtcnctatctattntgtcgttacggaaggtcggaacttacggtccaccgttaccgtacggccgaccgacccgaacggaccccaaccccgtcgtcgttcctaaccgttccgtccg

SEQ ID NO: 424568 - DNA, 780 bp, Homo sapiens
  misc_feature: GZ8MTXP01E01KQ.44.27.C05.1.454.CMB.2.raw
  modified_base (337)..(337): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccagtaggggggtccctgagactctcctgtgcagcctctggattcaccttcgataattggaatatgcagtgggtccgccaggctccaggcgaggggctggagtgggtggcagggtgtgtcatttcatggaggaaatcaagtcacggtgattccgtgagggccgattcaccatctccagagacaattccgagaacacagtntctcttacaaatcgaacagcctgacgaaccctacgaagggaccacgggcccgttagttacttttttggacgtacgtaagtaacttaacttacgttacgtttaaccctaaaaagtttccgggtttactaacgtttaccggaaccggcccggttacggggggaccccaaacggggggtaaacccccggttcggggttacccgtaaccccggtttcccgttaccccgtaccccggggtacccccttaaccccgaaaccccgtaaaccgggggtacccccctaaacgttccccggggttccccgtttccccccccggtacggggcccccgtacccccgtttccggaccccgttaccccgaacggggaacccggacccctaaaccccggtaccccggaaacggaaccgggaccccaaaccggtaaccgggccccggggtcccccgggg

SEQ ID NO: 424569 - DNA, 612 bp, Homo sapiens
  misc_feature: GZ8MTXP01B6TDE.44.27.C05.1.454.CMB.2.raw
  modified_base (267)..(267): a, c, t, g, unknown or other
  modified_base (306)..(306): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntggattcaccttcgataattggaatatgcaggtggtccncgaggctccgaggcgaggggctgggagtggggtggcgaggtgtgtctatttcgagtggaagaaatcaaagtcgtacgggtgacgtttccggtggacggggtcctattccgactactctccagacgaacacgttaccgaagaacacgagtcgtcttacgttacaaagtacgaacagcctagacgaccgtcgacggacgtaccggtccgttgttacgttttggtcgttcgtacgtacttacgttcgttacgtttaaccgtaaaagttcggttactacgttaccggtaaccgttcccggtaaccggggg

SEQ ID NO: 424570 - DNA, 545 bp, Homo sapiens
  misc_feature: GZ8MTXP01BIOQN.44.27.C05.1.454.CMB.2.raw
  modified_base (224)..(224): a, c, t, g, unknown or other
  modified_base (310)..(310): a, c, t, g, unknown or other
  modified_base (427)..(427): a, c, t, g, unknown or other
  modified_base (431)..(431): a, c, t, g, unknown or other
  modified_base (445)..(445): a, c, t, g, unknown or other
  modified_base (459)..(459): a, c, t, g, unknown or other
  modified_base (526)..(526): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaattgtctcctggtatcaacatcatccaggtaaacgcccccaaatcatcatctatgagcctanaagagccctgagggtttctaatcgcttcacctgcctccaaagtcccggacaacgccggccctccctgaactaatctcgtggcctccaggctgaggacgaggctgtattattattgtncgtnagtatgttcggtcncatctaaacgtttntcgtcgttacgggaggtcggacttaaggtccacgtccgtacgttcgcgacccgaacgcccaaccctntcgttcctcgttccgtccg

SEQ ID NO: 424571 - DNA, 801 bp, Homo sapiens
  misc_feature: GZ8MTXP01DCE7F.44.27.C05.1.454.CMB.2.raw
  modified_base (291)..(291): a, c, t, g, unknown or other
  modified_base (303)..(303): a, c, t, g, unknown or other
  modified_base (350)..(350): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtcggccccgaggtacgggggtccctgagctctcctgtgcagcctctggacttcacttgataatggaatngcaggtcggccncaggctccgaggcggaggggctgggagtggggtggcgtaggtgtgtntatttcagtaggagtaaatcgaaaagttctaacgggtgtacgtttacccgggttgggaacggggtcccgtatttcccgaaccctacttaccgtacccgaaggaacgtaaaccgtaaacgtttacccggaacgtaaaaccgaaccgtaacgttacgttacctttaacctttaaccggtaaaaacgttacggaaaaccgtaacgtccccgttaaacgggaacccggtaacccgttaaccggaaaccgggtaacccgtaaacccgggggtaccccgggttttaaggttttaaaccggttttttgggttacgggttaaacccggttaaggttaaacctttaacgtttaccggttttaaccggttttaaacccgttaaaaaacgtttccgggttttaacctaaccggttacccgggttacccgggttcccgggttaaccggggggtaacccccggg

SEQ ID NO: 424572 - DNA, 767 bp, Homo sapiens
  misc_feature: GZ8MTXP01ALXGB.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccccagactctcctgtgcagcctctggacttcaccttcgaataattggaatatgcaggtcgggtccgccgaggcctccgagggcggagggggcgtgggaggtggggtggcgaggttgtgtctatttccgagttgggaagtaaatcgaaaagttccgtaacgggtgtaacgtttccggttaggacggggtcccgtaattcccaccctactaccgtaccgaacgtaacgaacctaaacgttacccgaaacggaaaccaaccgtaggtacgttacctttaccgttaaacgtaaaacgttaacgaaaccgtaacgtaccccgttacggaaccgtaacccgttaacccgaaaccgggtaacccggaaccgggttacccggtttacggttttaacggtttttggttacggtaccggttaacggttaaaccgtttaacgtttaccgtttacggttttaacccttaaaagttcccggtttaacgtaaccgtttaccggacccggtaaccgggttaaccgggggtaaccccgg

SEQ ID NO: 424573 - DNA, 558 bp, Homo sapiens
  misc_feature: GZ8MTXP01BCJRW.44.27.C05.1.454.CMB.2.raw
  modified_base (212)..(212): a, c, t, g, unknown or other
  modified_base (284)..(284): a, c, t, g, unknown or other
  modified_base (396)..(396): a, c, t, g, unknown or other
  modified_base (530)..(530): a, c, t, g, unknown or other
  modified_base (537)..(537): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccnccaggctccaggcgaggggctggagtgggtggcagggtgtgtcatttcagtggaggaaatcaagtcacggtnattccgtgagggccattcaccatctccagagacaattccgagaacacagtgtctcttacaaatcgaacagcctagacgaaccctgaaggacacgggtccgttgtatttttgngcgagtactatctgttaccaaattcggttctattcgacgtccgtggggaccacgggaaccctggtcaccgtctcctccggcctccaccgacggcccactccggtcctcccctgccgcccttgcctccacggccnccaaccncgaacgcgcacgcgccggccg

SEQ ID NO: 424574 - DNA, 719 bp, Homo sapiens
  misc_feature: GZ8MTXP01A52OR.44.27.C05.1.454.CMB.2.raw
  modified_base (305)..(305): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggagcgtggccccgaggtacgggggtccctgagactctcctgtgcagcctctggattcaccttgataattggaatatgcaggtggtccnccaggctccgagggcgaggggctgggagtggggtggcgaggttgtgtcatttccgagtgggaagaaatcgaaaagttcgtaacggtgtaacgttcccggttaggacggggtccctaaattcccaccgtattcctacccgaggaacgaacctaaagttacccgaaagaaacctaaccgaagttacgttaccttaccgttaacaaaaacgtttacggaaaacctaacggtaccccgttaaggaaccggtaacccgttaccggaacgggtaaacccgtaccggggtacccggttaggtttaacgtttttggttacggtacccgttaaggtaccttaacgttcgtttcgtttaaaccgtaaaagttccgggttaactacgtttaccgggaccgtcccggttaacggggtaaccccggg

SEQ ID NO: 424575 - DNA, 622 bp, Homo sapiens
  misc_feature: GZ8MTXP01AQNOD.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtcgggtccgccaggcctccgagggcggagggggctgggaggtggggtggcgagggtgtgtctagtttccagttggaaggaaatcgaaaagttcgtaacgggtgtaacgtttcccggttggacggggtcccgtatttcccgaccactcctaccagagaacaaacttccgaagaacacagtgtctactacaaatagaacacgacctgacgaccgtacgacggaccgaccggtccgttgttaacgttttgttgtcgagtacgttacttcgttcgtttacctaaaagttccggttaactacgttccggaccgtccggttcggggaacccgg

SEQ ID NO: 424576 - DNA, 748 bp, Homo sapiens
  misc_feature: GZ8MTXP01BVOEI.44.27.C05.1.454.CMB.2.raw
  modified_base (267)..(267): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggaggcgtggccccgaggtacgggggtccctgagactctcctgtgcagcctntggattcacttcgataatgaatatgcaggtggtccgcaggctccgaggcggagggggctgggaggtggggtggcgagggttgtgtctatttccgagtagggaagtaaatcgtaaaagtcgtaacgggtgtacgtttcccggttaggacggggtcctaattcccaccctatcctaccgaagaacgtaacctaaacgttaccggaaacgtaaaccaacgtaacgttacgttaccttacctttaacgtaaaacgttacggtaaaccacggtacccgtaacggaaccgaccccgtacgaaaccgggaaccgtacccgggtacccggtttggtttaaagttttttcggttacgggtaaccggttaaggttaacctttaacgtttaccgtttacgttttaaaccccgtaaaaacgtttccgggtttaaccttaacggtttacccgggttacccgggtaaccccgggttaaccgggggtaaccccggg

SEQ ID NO: 424577 - DNA, 615 bp, Homo sapiens
  misc_feature: GZ8MTXP01CI4I2.44.27.C05.1.454.CMB.2.raw
  modified_base (307)..(307): a, c, t, g, unknown or other
  modified_base (544)..(544): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggaggcgtggccccaggtagggggtccctgagactctcctgtgcagtcctctggattcgaccttcgataattggaatatgcaggtcggtccncgaggcctccgaggcggaggggctgggaggtgggggtggcgaggtgtgtctatttccgagtggaacggtaaatcgaaaaggttcctaacgggtgtaacgtttccggttaggacggggtcccgtattccacccgtatcctccagacgacaacttaccgaagtaacacagtcgtctcttacgaactagaacacgcctgacgtaccacgacggaccgacggtccgttgttaacttttggngtcgagtactcttcttcgtttaaccgtaaagttcggttaactacttccggacgtccgttaacggggtcccg

SEQ ID NO: 424578 - DNA, 631 bp, Homo sapiens
  misc_feature: GZ8MTXP01D4GE8.44.27.C05.1.454.CMB.2.raw
  modified_base (262)..(262): a, c, t, g, unknown or other
  modified_base (545)..(545): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctcnggatcacttcgataattggaatatgcagtggtccgccaggctccgaggcggaggggctgggagtgggtggcaggtgtgtcatttccatgggagtaaatcaaaagtctaacgggtgtacgtttcccggttaggacgggtccgtatttccacctattcctacccgagacgaactaaacgttacccgaagaaccacgaagtcgttacttaccttacgaaactaggaaactacgaccgtgacgacctacgaacggtaaccgaacggtccggtagttaagtttttggnggtacgttaggtacttacttcgttcggtttaaccctaaaagttcggttaacgtacgttccggacggtccggttcggggtaacccgg

SEQ ID NO: 424579 - DNA, 588 bp, Homo sapiens
  misc_feature: GZ8MTXP01CXVY6.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccagtagggggtccctgagactctcctgtgcagcctctggattcaccttcgataattggaatatgcaggtgggtccgccaggctccgagggcgagggggctgggaggtggggtggcgagggtgtgtcatttccatggaggaaatcgaaaagttctaacgggtgacgtttcccggttggacggggcccgtaattccacctatcctccagagacaattccgaagaacacagtgtactcttacaaatcgaacacgcctgacgacctacgacggtacacggtccgtgttaattttgttgcgagtacttattcgttcgtttacctaaattcggttctagttccgacgtcccgttcggggaacccg

SEQ ID NO: 424580 - DNA, 641 bp, Homo sapiens
  misc_feature: GZ8MTXP01ERK7L.44.27.C05.1.454.CMB.2.raw
  modified_base (293)..(293): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagctctcctgtgcagcctctggattcacttgatatgatatgcagtggtccncaggctccgaggcgagggctgggagtggggtgcaggtgtgtctatttccagtggaagaatcgaaaagtctaaggtgtactttcccggtagacggggtccgtattcccacctatctaccagagactaaacgttaccgaacgaacaccgtagtacgttacttacttaacgaaagttacggaaacacgaccgtagaacgtacccgtacgaacgggaacctaccgggtcccgttagtttaacgtttttggttacggtaccgttaagtaccgttaattaccgtttacggtttaacctaaaagtttccggttaactacgtttaccggacggtcccggttaaggggtaaccccgg

SEQ ID NO: 424581 - DNA, 610 bp, Homo sapiens
  misc_feature: GZ8MTXP01B6AJS.44.27.C05.1.454.CMB.2.raw
  modified_base (295)..(295): a, c, t, g, unknown or other
  modified_base (306)..(306): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctggagactctcctgtgcagcctctggattcaccttcgataatggaatntgcagtggtcncaggctcaggcgagggctggagtggggtggcaggtgtgtctagtttcagttgggaacggaaatccaaagtcgtacgggtgaagtttcccggttgacggggtccattcaccatctccagagaacaattccgagaacacagtgtctcgttacaaatcgaacacgcctagacgacctcgtaacggaccgaaccgggtcccgtaaggttaacgtttttggtcgttcggtaacgtaccttaagttcctttacggtttaacctaaaacgttccggttactacgttccgtaaccggttccgtaaccggggg

SEQ ID NO: 424582 - DNA, 701 bp, Homo sapiens
  misc_feature: GZ8MTXP01DMV5D.44.27.C05.1.454.CMB.2.raw
  modified_base (263)..(263): a, c, t, g, unknown or other
  modified_base (301)..(301): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtcctgagactctctgtgcagcctcnggattcaccttgataattggaatatgcaggtcggtccnccaggctccgaggcggaggggctgggaggtgggggtggcgaggttcgtgtctattttccgagttagggaaggtaaactcgaaaagttcgtaacgggtgtacgtttcccggttgggaacgggtccgtagttccacctatcctaccgaagtaacggaactaaacgttccgaaacgtaaacacgtaacgtcgttacttacttacaaaagttcgaaacgtacgtaccgttacgaacgtaccctaacgacggtaaccgacgggtacccgttggtttaacgtttttggttacggtcggttaagttaaaccttagtttaccgtttacggttttaaacccgtaaaaacgtttccgggttaacttacgttaccggttaaccgtcccgggttaacgggggtaaccccggg

SEQ ID NO: 424583 - DNA, 647 bp, Homo sapiens
  misc_feature: GZ8MTXP01EZB1K.44.27.C05.1.454.CMB.2.raw
  modified_base (290)..(290): a, c, t, g, unknown or other
  modified_base (302)..(302): a, c, t, g, unknown or other
  modified_base (384)..(384): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctctggattcacttgataatggaatangcagtcggtccncaggctccgaggcgagggctgggagtgggtggcgaggtgtgtctatttccagtggagaagtactaacgtaagtcgtagggtntacgttcggtaggacgggctactacactactcacgagacgtaactacggttaccaacgaacgtacgtacgttacgttcttaacttaaactaaacgtaacgaacgaccgtccgtaagacccgtaaccgacgaaccggtaccggtaccggttggttaagttttggtttagacggttcgtaattaaccgttagtttcgtttaacccgttaaacgtaacgtttccggttactacgttcccggaacccggtttcggggtaacccgggg

SEQ ID NO: 424584 - DNA, 611 bp, Homo sapiens
  misc_feature: GZ8MTXP01DY9QQ.44.27.C05.1.454.CMB.2.raw
  modified_base (305)..(305): a, c, t, g, unknown or other
  modified_base (480)..(480): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctctggacttcaccttcgataattggaatatgcaggtcggtccnccaggctccgaggcgagggggctgggagtgggggtgcgaggtgtgtcatttccagtaggaggaaatcgaaaagtctaacgggtgtaacgttcccggttggacggggtccattccaccatctaccgagagaacaaattccgaagaacacagtgtctactacaaatgaacagcgtanagacctacgacgacgaacggtccgttgttaagttttagttggtacgttacgtacttacttcttacggtttaacctaaaagttcggtttaacctaacgttaccggttaaccgtccgttcggggtaaccccgg

SEQ ID NO: 424585 - DNA, 621 bp, Homo sapiens
  misc_feature: GZ8MTXP01DGQG3.44.27.C05.1.454.CMB.2.raw
  modified_base (340)..(340): a, c, t, g, unknown or other
  modified_base (413)..(413): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggattcaccttcgataatggaatatgcagtggtccgccaggcctccgaggcgagggggctggaggtggggnggcgagggtgtgtctagtttcagtggaagaatacaagtcgtaggtgattccgtagacgggtccattcacatcncagagacactacgagaacacagtgtctcttacgaaatacgaacacgtaccgtgacgaacctcgaaggtacccgacgggtcccgtttaaggtttacgtttttggtcgacggtaacggtactttacgttcgtttaacgttttaacccgtaaaaaacgtttccggttacgttactttaccgggtaacccggttcccggttaacccgggggg

SEQ ID NO: 424586 - DNA, 669 bp, Homo sapiens
  misc_feature: GZ8MTXP01BMOVX.44.27.C05.1.454.CMB.2.raw
  modified_base (174)..(174): a, c, t, g, unknown or other
  modified_base (268)..(268): a, c, t, g, unknown or other
  modified_base (337)..(337): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggaggcgtggccccgaggtagggggtccctgagactctcctgtgcagcctntggattcaccttcgataatggaatatgcaggtggtccgcaggctccgaggcgaggggctggagtggggnggcaggtgtgtctatttcgaagttggggaaggtaaatcaaaggttcgtaacgggtgtaacgtttcccggtgggacggggccgtatttccacctacgtcctaccgaagagtaataacttccgaagtaacacgtagtcgttctacgttactaaagtcgaaacacgtacccgtagacgaacccgtcgaacgggtaccgtaaccgggtcccggttaaggttttaacgtttttgggtcgttaccggtaaggtaccctttaagttccgttacgttttaacccgaaaacgtttccggtttacctacgtttaccggaaccgttccccggttaaccggggg

SEQ ID NO: 424587 - DNA, 698 bp, Homo sapiens
  misc_feature: GZ8MTXP01BTYQJ.44.27.C05.1.454.CMB.2.raw
  modified_base (267)..(267): a, c, t, g, unknown or other
  modified_base (290)..(290): a, c, t, g, unknown or other
  modified_base (298)..(298): a, c, t, g, unknown or other
  modified_base (322)..(322): a, c, t, g, unknown or other
  modified_base (328)..(328): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcgttgggttttcctcgttgccctcttaagaggtgtcatgtgtcaggtgcaattcgtggagtcgtgggggagcgtggccccgaggtacgggggtccctgacgactctctgtgcagcctntggatcactgataatgatatgcngtggtccncaggctcgaggcgaggggctgggngtgggngctaggtgtgtcatttccagtaggaaggaaatcgaaaagttctaacgggtgtacgtttccgggttaggacggggtccgtaattcccgaacctatccgtaccgaaggtaacaaactaaacgttaccgaaacgtaaccgaacgtagtacgttacttaacctttaacgaaaagttacgaaaccgacggtacccttaaggaaccgtaacccgttaacggaacgggtaacccggtaacccgggttcccgttaggttttaagtttttcgggcgtaaccggttagtaaacccgtttaattcccgttaacgtttaacctaaaagttccgggtttaactaccggtttccgacccgggtcccggttcgggggaaccccgg

SEQ ID NO: 424588 - DNA, 579 bp, Homo sapiens
  misc_feature: GZ8MTXP01AHLSC.44.27.C05.1.454.CMB.2.raw
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagctctcctgtgcagcctctggattcaccttcgataatggaatatgcagtggtccncaggctcgaggcgaggggctggaggtgggtggcgaggtgtgtctatttcagtggaggaaatcaagtctacgggtgattccgtgagggccattcacatctcagagacaattccgagaacacagtgtctcttacaaatgaaactagccctagacgaacctcgaggaccgacgggtccgttgttagtttttggtcgttcgtaagtacttattccttacgttttaaccctaaaagttccggttactaacgtttccggaaccgttccggtaaccggggg

SEQ ID NO: 424589 - DNA, 661 bp, Homo sapiens
  misc_feature: GZ8MTXP01BIDDY.44.27.C05.1.454.CMB.2.raw
  modified_base (265)..(265): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctcnggattcaccttcgataattggaatatgcaggtggtccgccaggctccgaggcgagggggctgggaggtgggtggcgtaggtgtgtcatttccgagtgggaaggaaactcgaaaaagttctaacgggtgtaacgttcccgggttgacggggcccgtaatttcccacctatcctaccgaagtaacgaactaaacgttcccgaagaaacaactacgtgttacctacttacgaaaattagaaaccacgaccgtagacgacctacgacggaaccgaccgggtccgttgtttaacgtttttggttcgtacggttaagtaaccttagttacgtttcgtttaaccctaaaagtttccggtttaactacgtttaccggacccggtcccggttcgggggtaacccg

SEQ ID NO: 424590 - DNA, 608 bp, Homo sapiens
  misc_feature: GZ8MTXP01AVM1C.44.27.C05.1.454.CMB.2.raw
  modified_base (352)..(352): a, c, t, g, unknown or other
  modified_base (403)..(403): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccaggtaggggggtccctgagactctcctgtgcagcctctggattcaccttcgataattggaatatgcagtgggtccgccaggctccaggcgaggggctgggagtgggtggcagggtgtgtcatttcagtggaaggaaatcaagtctacggtgattccgtggagggccattcaccatctccagagacaattccgaagaacactagtgtactctanaaatcgaacagcctagacaacctcgaaggacacgggccgttgttattttgngcgagacttatcttcttaccaaattcggttactactcgtacgccgtaggggccagggaccgttcggccgtaccgtcgtccgtaccggccctaccaccgaacgggtcccctacgtcccggtccctcccctcggcccgtccccgttggccctccgaacgggcacccgaacccgccggaacgccggcacccggtcgcccgggtccccg

SEQ ID NO: 424591 - DNA, 762 bp, Homo sapiens
  misc_feature: GZ8MTXP01BRI5N.44.27.C05.1.454.CMB.2.raw
  modified_base (265)..(265): a, c, t, g, unknown or other
  modified_base (290)..(290): a, c, t, g, unknown or other
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacgggggtccctgagactctcctgtgcagcctntggattcacttcgatattggaatangcagtggtccncaggctccgaggcgagggggctgggaggtgggtggcgtaggtgtgtctatttccgagttgggaaggtaaatcgaaaaaggttcgtaacgggtgtaacgtttcccgggttaggaacggggtccgtaatttcccaacctatccgtacccaaggaacgtaactaaacgttacccggaaagtaaaccgtaaccgtaagttacggttacctttaacctttaaccgaaaaaagttacggggaaaacctaacggtaccccgttaggaaacccggaaccccgttaaccggaaaccggggtaaccccggtaaacccgggttacccggtttaacgggttttaagtttttttcgggacgggttaaccggttaaaggttaaccgttaactttacgtttacgtttaaacccgtaaaacgtttccgggttaacttacgttccggttaccgtccccgggttcgggggtaaccccgg

SEQ ID NO: 424592 - DNA, 627 bp, Homo sapiens
  misc_feature: GZ8MTXP01DGE39.44.27.C05.1.454.CMB.2.raw
  modified_base (190)..(190): a, c, t, g, unknown or other
  modified_base (236)..(236): a, c, t, g, unknown or other
  modified_base (459)..(459): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatnttcttagtcttaactttgtctcctggtatcaacatcatccaaggtaaacgacccccaaactcaatcatctatgaggcctaataagacggccctcgtagggggtttactaatcgtctcacctcggctaccgaacgtcccgaacaaccgccggccctcccgtacgacaactctctcggggcctccgaggccgtagaggacgaggctgtatttattattgttgctnagtattgttcgtctctatctaacttagtgttaccgttacggaaggttaacgggaaccgttaaacggttcccgttaccggtcccgttaacgggttccaacccggaccccgaaaccgggaccccaaacccccgtaactccggttaccctaaccgtttcccgtttcccccg

SEQ ID NO: 424593 - DNA, 719 bp, Homo sapiens
  misc_feature: GZ8MTXP01AXQ78.44.27.C05.1.454.CMB.2.raw
  modified_base (264)..(264): a, c, t, g, unknown or other
  modified_base (298)..(298): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctcnggattcacttgataatggaatatgcagtggtccncgaggctccaggcgagggggctgggagtggggtggcgagggtgtgtctatttccgatgggaaggaaatcgaaaagttcgtaacgggtgacgtttcccgggttggaacggggtccgtaatttccacccgtacttccgtaccgaacgaacgaacaaacgtttacccggaaacgaaaccaacgtaacgttacggttaccttactttaaccgaaaagttaacggtaaaccaacgtaccccgttaggaaccggaacccttaccggaacgggtaacccgtaacccgggtacccggtttacggtttaagtttttcggttggtacccggttaaggttaacccgttaatttaccgtttacgtttaacccgtaaaaacgtttcggttaacctacgtttaccggaccggtcccggttcgggggtaaccccgg

SEQ ID NO: 424594 - DNA, 737 bp, Homo sapiens
  misc_feature: GZ8MTXP01ATTCR.44.27.C05.1.454.CMB.2.raw
  modified_base (337)..(337): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggacttcaccttgataattggaatatgcaggtcggtccgcaggctccgaggcgagggggctgggaggtggggnggcgtaggtgtgtctatttccagtgggaaggaaatcgtaaaagtcgtaacgggtgtaacgtttcccggttaggacggggtccctagttacccaccctacttaccgtaccgacggtaacgaactaaacgttaccgaacggtaaaccaaccgtagttacggttaccttacctttaacggtaaaacgttacggaaaccgtacgtacccgttacggaaccggtaacccctaccgaaacggggtacccggtaccgggttcccgtttaggtttaacgttttttcgggttacgggtacgttacgggttaaccttaacgttaccgtttaccgttttaaccgtaaaacgtttccggtttaaccgttacgttaccggttaccggtaacccggttccgggggtaaccccgg

SEQ ID NO: 424595 - DNA, 664 bp, Homo sapiens
  misc_feature: GZ8MTXP01APCZJ.44.27.C05.1.454.CMB.2.raw
  modified_base (589)..(589): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtggggggaggcgtggccccgaggtacggggggtccctggagactctcctgtgcagcctctggattcaccttgataattggaatatgcaggtgggtccgccgaggcctccgagggcggagggggctgggaggtgggggtggcgtagggtgtggtctatttccagtgggaaggtaaaatcgaaaaaggttcttaacgggtgtaacgtttcccgggttggacgggggtccctaagttcccaccctactcctacccgaaggtaacgaactaaacgttacccggaaacgaaccaacgtacgttacgtaccttacttacgaaactacggaaacacgcctagacggacctacgacggtaccgacggtccgttgttaattttggngtacgagtacttattcgttcgttaccgtaaaacttcggttaactacgttccggacggtccgttcggggtaacccg

SEQ ID NO: 424596 - DNA, 657 bp, Homo sapiens
  misc_feature: GZ8MTXP01APIKN.44.27.C05.1.454.CMB.2.raw
  modified_base (260)..(260): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcngcctcgtggattcaccttgataagttggaatatgcaggtcgggtccgccaggcctccgaggcgagggggctgggagtgggtggcgaggtgtgtcatttccagtaggagtaaatcgaaaagttcgtaacggtgtacgtttccgttggacgggtccctattcccacctactccgtacagaacgactaaacgttaccgaacgaaacactaggttacgtacttacttaacaaagttacggaaaccacgtaccgtacgaacgtaccctacgaacgggaaccgtaccgggtaccgttggtttaacgtttttggttacgtaccggttagtaacgttacttcgttacgtttaaccgtaaattccggttaactaacgttcggaccgtccggttcggggtaacccgg

SEQ ID NO: 424597 - DNA, 579 bp, Homo sapiens
  misc_feature: GZ8MTXP01A12T6.44.27.C05.1.454.CMB.2.raw
  modified_base (289)..(289): a, c, t, g, unknown or other
  modified_base (508)..(508): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatangcagtggtccgcaggctccgaggcgaggggctgggagtgggtggcgaggtgtgtcatttccgatgggagaaatcaaaagtctaacggtgagttccgtgagggcctattccaccatctccgagacgacaacgttccgaagaacacgagtgtacttacttacaaactagaacagacctgacgaccgtacgacggacgaccgggtccgtgttaacttttggngtcgaggtactattcgttcgtttaccgtaaattcggttaactacgttcgacgtccggttcggggtaacccg

SEQ ID NO: 424598 - DNA, 596 bp, Homo sapiens
  misc_feature: GZ8MTXP01BBRF3.44.27.C05.1.454.CMB.2.raw
  modified_base (305)..(305): a, c, t, g, unknown or other
  modified_base (380)..(380): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctggattcaccttcgataattggaatatgcagtgggtccnccaggctccgaggcgaggggctgggagtgggtgcaggtgtgtcatttcagtggaggaaatcgaaagtctcgggtntacgtttccggtgacggggtccattccacctatctaccagagacaacttccgaagaacacagtgtctacttacaaatgaacacgctagacgacctacgacggaccgacggtccgttgttaagtttttggttggtacgaggtaacttaacttcgttcggtttaacctaaaacttcggttaactacgtttcggaccggtccgttcgggggtaacccgg

SEQ ID NO: 424599 - DNA, 748 bp, Homo sapiens
  misc_feature: GZ8MTXP01EOHZM.44.27.C05.1.454.CMB.2.raw
  modified_base (307)..(307): a, c, t, g, unknown or other
  modified_base (327)..(327): a, c, t, g, unknown or other
  modified_base (356)..(356): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggttttcctcgttaggccctcttaagaggtgtcatgtgtcaggtgcaattcgtggagtctgggggaggcgtggcccccaggtaggggggtccctgagactctcctgtgcagcctctggattcaccttgataattggaatatgcagtggtccnccaggctccgagcgagggcnggagtgggtggcgaggtgtgtcgtacttntagtaggaggaagtaaccgtaagtcgtaccggtaggtacgttaccggttacggtacggggtaccgggtacgttacctaacccaacgttccgttaccctaacgaaggaaaccgtaaaccttaacccggaaccgaaacgtaacccaacgttaagggttccgttaccgtttaacccgtaaaacgttaaaacgaaaccgtaaccgtaccgtacgtaaccgtaacccgtaccgtaaccggtaaccggtacccggttaccggttaacggttttaacgttttacggttacggttacggtaacgttaacgttaacgtttaccgtttaaccgtttaacccgttaaacgttaaccggttacgttaccgttaccggtaacccggttaacccgggtaaccgggg

SEQ ID NO: 424600 - DNA, 605 bp, Homo sapiens
  misc_feature: GZ8MTXP01DDCT1.44.27.C05.1.454.CMB.2.raw
  modified_base (291)..(291): a, c, t, g, unknown or other
  modified_base (301)..(301): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatangcagtggccncgaggctcgaggcgagggctgggagtgggtgcgtaggtgtagtctagtttccagtggaaggtaaactcgaaaagtctaacggtgtatttccggtgacgggcccgtattccacatctaccaagagacaaattccgaagaaacaacgagtacgtctactttaacaaattacgaaacacggacctaggacacctacgacgaccgaccggtccgtgttaattttggcgtcgacgtacttattcttcgtttaacctaaaacgttcggtttaactaacgttcggacccgtccggttcggggtaaccccgg

SEQ ID NO: 424601 - DNA, 575 bp, Homo sapiens
  misc_feature: GZ8MTXP01AZTMV.44.27.C05.1.454.CMB.2.raw
  modified_base (190)..(190): a, c, t, g, unknown or other
  modified_base (224)..(224): a, c, t, g, unknown or other
  modified_base (235)..(235): a, c, t, g, unknown or other
  modified_base (368)..(368): a, c, t, g, unknown or other
  modified_base (453)..(453): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttctagtcttaattgctctgtatcaacatcatcaagtaaacgccccaaactcatcatctatgacgcctaataacgacggtccctacgtaggggtttactaatcgcttcacctgctacaagtcccggaacaacncggccctcccgtagactaatctcgtcggctccgaggctaggaggagaggctagatttattattgttgctgagtatcgttcgtcgnactctaacttatgttcgtacgggaaagtcgggaacccttaaggggtccaccggttacgtaacgggttcacgaccccgaaacggacccaaaccccgacttcgttcctaaccgttccttccccg

SEQ ID NO: 424602 - DNA, 626 bp, Homo sapiens
  misc_feature: GZ8MTXP01CF3N2.44.27.C05.1.454.CMB.2.raw
  modified_base (276)..(276): a, c, t, g, unknown or other
  modified_base (315)..(315): a, c, t, g, unknown or other
  modified_base (350)..(350): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtcggccccgagggtacggggggtcccctggagacctctccgtgtgcagcctntggatcaccttgataatggaatatgcaggtcgggtcccncgaggcctccgaggcggaggggctgggaggtgggnggcgtggtgtgtctagtttcgagtggaagaaatcgaaagtcgtagggtgtacgttcccgtaggacgggccgtattccgacctatcctaccaagacgaactaacgttaccgaacgaacactaagtcgtacctacgttaacaaatcgaaacacgtcctagacgaacctcgacggaccgtacggtccgttgtttacgttttggacgttacgtagtacttagttcttacgtttaacctaaaagttccgttactacgttccgtaaccgttcggtaaccggg

SEQ ID NO: 424603 - DNA, 620 bp, Homo sapiens
  misc_feature: GZ8MTXP01A3BXT.44.27.C05.1.454.CMB.2.raw
tcagacagtatatacacgaccggtgctcgatttagacgcgatcgaagggtttggggacccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctcgtggattcaccttcgataattggaatatgcaggtcgggtccgccaggcctccgagggcgagggggctgggagtggggtgcgaggtgtgtcatttccagtgggaaggaaatcgaaaagttctaacgggtgtagtttcccggttgacgggccgtaattccacctatcctaccgagacgaactaacttaccgaagaaacacgtagtcgtactactacgaaatacgaacacgcctagacgacctacgacggaccgacggtccgttgttaagttttgttgtaccgagtactacttcgttacgtttacctaaaagttcggttaactacgttccggaccgtccggttcggggtaacccgg

SEQ ID NO: 424604 - DNA, 644 bp, Homo sapiens
  misc_feature: GZ8MTXP01BWWR7.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgttggttttcctcgttgccctcttaagaggtgtcatgtgtcaggtgcaattcgtggagtcgtgggggaggcgtggccccgaggtacgggggtccctgagactctcctgtgcagcctctggattcacttcgataattggaatatgcaggtggtcccgcaggctccgaggcggaggggctgggaggtgggggtggcgagggttgtgtctagtttccagttggaagtaaatcgaaaagttcgtaacggtgtacgtttccggtaggacggggtccgtattccactactcctaccagaacgactaaacttacccgaagaacactacgtgtacttacttacggaaattacggaaaccacgtacctagacgtaccctacgaacggacgaccgggtccgttgtttaagttttggttacgtccgttaagtaccgttattcgttacgttaacctaaacgttcgttaacgacgttccggaccggtccggttaacggggaaccccgg

SEQ ID NO: 424605 - DNA, 617 bp, Homo sapiens
  misc_feature: GZ8MTXP01EMAO1.44.27.C05.1.454.CMB.2.raw
  modified_base (188)..(188): a, c, t, g, unknown or other
  modified_base (222)..(222): a, c, t, g, unknown or other
  modified_base (263)..(263): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatctcctgcactgganccagcgtaatattcttagtcttaacttgtctctgtatcaanatcatccaaggtaaacaccccaaatcatcatctatgagactaataagcgccctgtagggtttactaatcgcttcacctcgtcctaccaaacggtcccggaaacaaccgaaccggccctaccctcgaaactaactctcgtcggggacctccgaggctggaaggacgaggtctagtaatttattattgttagtctactaagtagttggttcgtacgtctattacctaatttagttgttacttacggggaagtaacgggtaaaccgaacggttccaccgttccgtaagggttaccacgaccccgaaacggaccccaaaccccgtactcgttaccctaaccgtttcccggttcccccg

SEQ ID NO: 424606 - DNA, 674 bp, Homo sapiens
  misc_feature: GZ8MTXP01A9Y0P.44.27.C05.1.454.CMB.2.raw
  modified_base (266)..(266): a, c, t, g, unknown or other
  modified_base (310)..(310): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacgggggtccctgagactctcctgtgcagcctntggattcaccttcgaataagttggaatatgcgaggtcgggtccnccgaggcctccgagggccggagggggctgggaggtggggtggcgaggtgtgtctagtttccagtggaagaaatcgaaaagtcgtcggtgtacgttccggttggacgggtccgtattacccgacctactccgtaccgaacgaacgtaactaaacgttaccgaacgaaaccaacgtagtcgttacttacttaacgaaagttacgaaacacgtaccgtagaacgaccgtacgaacggtaccgtaccggtaccgtttgttaacgtttttggttagtaccgttagtaacttacgttacgtttcgtttaacctaaaacgtttccggttaacgtacgttaccggaccggtcccggttcggggtaacccggg

SEQ ID NO: 424607 - DNA, 692 bp, Homo sapiens
  misc_feature: GZ8MTXP01DQV06.44.27.C05.1.454.CMB.2.raw
  modified_base (266)..(266): a, c, t, g, unknown or other
tcagacagtatatacacgaccggtgctcgatttagacgcgatcgaagggtttggggctgggagacgagcccagcactggaagtccgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctcnggattcaccttcgaataattggaatatgcaggtggtccgcgaggcctccgaggcggaggggctgggagtggggtggcgaggttgtgtctatttccagtagggaaggtaaatcgaaaagttcgttaacgggtgtaacgtttccggtggaacggggtccgtaatttacccaccgtactacctacccaaggacgtaaccgtaaacgtttcccgaaacggtaaaccaaccgtagtacggttaccttacctttaactaaaacgtacgtaaacgacgtacctaggacgaacctacgaacggtaccgtaaccgggtccgttaggttaacgtttttggttacggtcgttaagttaccgtaatttaccgtttacgtttaccgtaaaagttcggttaacctacgttaccggaccgtccggttcggggtaaccccgg

SEQ ID NO: 424608 - DNA, 563 bp, Homo sapiens
  misc_feature: GZ8MTXP01DPXU8.44.27.C05.1.454.CMB.2.raw
  modified_base (305)..(305): a, c, t, g, unknown or other
  modified_base (499)..(499): a, c, t, g, unknown or other
  modified_base (510)..(510): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtcnccaggctccaggcgaggggctgggagtgggtggcagggtgtgtcatttccatggaggaaatcaaaagtctaacgggtgattcccgttggagggccgattcaccatctccagagacaattaccgagaacacagtgtactcttacaaattgaaacagacctgacgacctacaggacacggtccgtgttaattttgngtcgagtactnttcttggtttacccaaaatcggttcacgtcgacggtccgttgggggtaacccg

SEQ ID NO: 424609 - DNA, 668 bp, Homo sapiens
  misc_feature: GZ8MTXP01BW8EX.44.27.C05.1.454.CMB.2.raw
  modified_base (293)..(293): a, c, t, g, unknown or other
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtgggccccgaggtacggggggtccctgagactctcctgtgcagcctctggattcaccttgatatggatntgcagtcggtcncgaggctcgaggcggagggctgggagtgggtgcagggtgtgtctatttcgagtggaagaaattcgaaagttcgtacgggtgtacgtttacccggtgggacgggcctagttccacctactctaccgagacgaactaacgttaccgaacgaacacgtaagtcgttaccttacgtttaaccaaattacgaaaccgacgtcccgtagaacgaacccgtcgtaaccgggaaccgtaccgggtcccggtgttttaacgtttttggtacggttacgtacggttaactttacgttcgtttacggttttaaccctaaaacggtttccggttaacctacggttcccgtaaccgggttccggttaacccggggg

SEQ ID NO: 424610 - DNA, 624 bp, Homo sapiens
  misc_feature: GZ8MTXP01BCRHM.44.27.C05.1.454.CMB.2.raw
  modified_base (188)..(188): a, c, t, g, unknown or other
  modified_base (221)..(221): a, c, t, g, unknown or other
  modified_base (232)..(232): a, c, t, g, unknown or other
  modified_base (280)..(280): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactgganccagcgtaatnttcttagtcttaacttgtctcctggtatcaacatcatccaggtaaacncccccaaatcatcatctatgagcctataagcggccctgtagggtttctaagtcgtcttcacctcgcctaccaacgtcccggaacaaaccgccggtccctccccgtacgacctaacttcctcgtcgggcctccgaggcctggaggacgaggcttagatttattattgttgctcgagtagttcgttcgtcgctacttctaactttatcggttacctttcgggaaggttcgggaaccttaaacggggttcccacccggttaccgtaacgggttaccccacggacccccgtaaacggacccccaaacccccgtacttccggttaccctaaccgttccctttaaccccg

SEQ ID NO: 424611 - DNA, 629 bp, Homo sapiens
  misc_feature: GZ8MTXP01DIQ3K.44.27.C05.1.454.CMB.2.raw
  modified_base (195)..(195): a, c, t, g, unknown or other
  modified_base (269)..(269): a, c, t, g, unknown or other
  modified_base (308)..(308): a, c, t, g, unknown or other
  modified_base (482)..(482): a, c, t, g, unknown or other
  modified_base (555)..(555): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtncaattcgtggagtcgtgggggagcggtggccccgaggtacggggggtccctgacgactctcctgtgcagcctcnggattcacttcgataattggaatatgcaggtcgggtccnccgaggcctccgagggcggaggggctgggaggtggggtggcgtagggttgtgtctattttccgagttgggaaggtaaactcgaaaaacgggttctaacgggtgtaacgtttccggtaggacggggtccgtattccacctatcctacgagagaacaagttccgaagaacatagtntactccttaaagaaactacgaaacgacgcctagacgaccgacgacgtaccgtacggtcgttgtttaagtttgngtcgagttacttgttacgtttacgttaacctaagttcgttaacgtacgtccggttaccgtcggttcgggaaccg

SEQ ID NO: 424612 - DNA, 584 bp, Homo sapiens
  misc_feature: GZ8MTXP01DSCMQ.44.27.C05.1.454.CMB.2.raw
  modified_base (162)..(162): a, c, t, g, unknown or other
  modified_base (292)..(292): a, c, t, g, unknown or other
  modified_base (301)..(301): a, c, t, g, unknown or other
  modified_base (327)..(327): a, c, t, g, unknown or other
tcagacagtatatacacgaccggtgctcgatttagacgcgatcgaagggttttggggctgggagacgagcccagcactggaagtcgccggtgtttccactcggtgatcatcactgaacacagaggactcaccatggagtttgggctgagcgtgggttttccncgttagccctcttaagaggtgtcatgtgtcaggtgcaattcgtggagtctgggggagcgtggccccgagtagggggtccctgagactctcctgtgcagcctctggattcaccttgataattggaatatgnagtggtccnccaggctccgaggcgaggggcgtggnggtgggtggcgaggtgtgtctattctagtggaaggaaatacgaaagtacgtcggttgtagttcgttgtagggcgattactacactctccagagacaacttacgaacgaacacagtagtctcttacaatagaacacgccgtagacgacgacgacgtacgacggtccgttgttaagtttgttgtcggttagtactacttacttacgttaccgtaaactacggttctacgttcgacgtaacccggttcgggtaacccggg

SEQ ID NO: 424613 - DNA, 586 bp, Homo sapiens
  misc_feature: GZ8MTXP01CNIIS.44.27.C05.1.454.CMB.2.raw
  modified_base (190)..(190): a, c, t, g, unknown or other
  modified_base (223)..(223): a, c, t, g, unknown or other
  modified_base (235)..(235): a, c, t, g, unknown or other
  modified_base (285)..(285): a, c, t, g, unknown or other
  modified_base (563)..(563): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactgganccagcgtaaatnttcttagtctttaactttgtctcctggtatcaacatcatccaagtaaacncccccaaactcatcatctatgaggtacctaagtaacgcggacccttagtagggttttcaattcgtcttcaccctcgcctacgtaacgtcccggaacaaccgccgtccctccctagacactcgtcgtcgggcctcgaggcgtggaggacgagtctagtatttattacttgtgactgagtattcgttcgtctctactctacttgtcgtacgttacgggaagttcggaacgttagttccaccgttcgtacgttccgacgacccgaacggccccaacccgtntacgttcctaaccttcgttcccg

SEQ ID NO: 424614 - DNA, 549 bp, Homo sapiens
  misc_feature: GZ8MTXP01BKDOG.44.27.C05.1.454.CMB.2.raw
  modified_base (189)..(189): a, c, t, g, unknown or other
  modified_base (221)..(221): a, c, t, g, unknown or other
  modified_base (233)..(233): a, c, t, g, unknown or other
  modified_base (279)..(279): a, c, t, g, unknown or other
  modified_base (365)..(365): a, c, t, g, unknown or other
  modified_base (432)..(432): a, c, t, g, unknown or other
  modified_base (464)..(464): a, c, t, g, unknown or other
  modified_base (541)..(541): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcacatctctgcacgtgganccagtcgtaatnttcttagtcttaacttgtctctgtatcaacatcatccaagtaaacnccccaaatcatcatctatgagacctaataacgacgtcctgtagggtttactaatcgcttcactcgctacgacgtccggaacaaccnccggcctcctacgactactctacgtcgggctacgaggctggaacggagagctgtattattattgttncttagaagtgttgttccgtgtctatctacttntcgttcgtacggaagttcggaacttaggtccacgtccgtaggcttagttcgtaagacgtaagagaattacgtaacgnggaagggg

SEQ ID NO: 424615 - DNA, 608 bp, Homo sapiens
  misc_feature: GZ8MTXP01ADJKY.44.27.C05.1.454.CMB.2.raw
  modified_base (268)..(268): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccaggtagggggtccctgagactctcctgtgcagcctntggattcaccttcgataatggaatatgcaggtggtccgccaggctgtaggcgagggggctggagtgggtggcaggtgtgtcatttcagtgggaagaaatcgaaagtcgtacgggtgatttcccggttggaggggtccctattccgaacctagtcctaccagagaactaaattccgaacgaaacacgaagtgttctacttacaaattgaaactagccctagacgacctacgacggacgaccggtccgttgttagttttgtcgacgtacgtacgttacttcgttacgtttaacctaaaagttccggttactacgttacgtaaccgttccggtaacccggggg

SEQ ID NO: 424616 - DNA, 642 bp, Homo sapiens
  misc_feature: GZ8MTXP01E28QZ.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcacttcgataattggaatatgcagtgggtccnccaggcctccgaggcgaggggctgggaggtggggtggcgagggtgtgtctatttccagtggaaggaaaatcgaaaaagttcctaacgggtgtactttccgggttggacggggtccgattccaccgtatcctaccgagaacgactaaattccgaagaaacacagtcgtacttactactaaatacgaaacacgaccctagacgaaccctacgacggaaccgacggtccgttagtttaacgttttggttcggtacgttagtaacttacttacgttacggtttaaccctaaaagttccggtttaactacgttaccgaccggtcccggttcgggggtaaccccgg

SEQ ID NO: 424617 - DNA, 558 bp, Homo sapiens
  misc_feature: GZ8MTXP01CL4TI.44.27.C05.1.454.CMB.2.raw
  modified_base (190)..(190): a, c, t, g, unknown or other
  modified_base (224)..(224): a, c, t, g, unknown or other
  modified_base (237)..(237): a, c, t, g, unknown or other
  modified_base (410)..(410): a, c, t, g, unknown or other
  modified_base (456)..(456): a, c, t, g, unknown or other
  modified_base (474)..(474): a, c, t, g, unknown or other
  modified_base (523)..(523): a, c, t, g, unknown or other
  modified_base (541)..(541): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctctgcactggacnccagcggttaatnttcttagtctttaactttgtctcctggtatcaacatcataccaaggtaaacgccccaaactcatcatctatgacggacctaagtaagacggccctacgtaggggtttctaaagtcgcttcacctcgacctcgaacgtccggaacaacgccgccctccctagaaccaatcctcncgggtcctccgaggctggaggacgaggtctgtatttatattgttantcgagtagttgttcgcgntatcctacttatgttctacggaagtcggaacaggtccacgtcgagttcngacccaacgaccaacccntcgctaacttcgtcccg

SEQ ID NO: 424618 - DNA, 601 bp, Homo sapiens
  misc_feature: GZ8MTXP01ER1YJ.44.27.C05.1.454.CMB.2.raw
  modified_base (303)..(303): a, c, t, g, unknown or other
  modified_base (527)..(527): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtatcaggtgcaattcgtggagtcgtgggggaggcgtggccccgaggtagggggtccctgagactctcctgtgcagcctctggattcaccttcgataattggaatatgcagtggtccncaggctccaggcgagggggctgggagtgggtgcgaggtgtgctatttcagtggaggaaatcgaaaagttctaacgggtgtaagtttcccggttggaacggggtcccgtaatttccgaacctatcctacccagagaacaaacttccgaagaacacgagtgtctacttacaaatagaaacagcctagacgacctacacggtaccacggtccgtgttaacttttggngtacgagtactattcgttcgtttacctaaaagttcggttaactacgtttccgacgtccgttcggggtaacccgg

SEQ ID NO: 424619 - DNA, 625 bp, Homo sapiens
  misc_feature: GZ8MTXP01AZ18Y.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcgaggtgggtcccgccaggcctccgaggcggagggggctgggagtgggggtggcgaggtgtgtctatttccgagtggaagaaatcgaaaagttctaagggtgtaacgtttcccggttggacggggcctagttcccacctactcctaccagacgaacaacgttaccgaagaacacgagtacgtactcttacaaacgtagaaacacgaccgtagacgaccgtacgacggaccgacggtccgttgttaagttttgttggtccgttagtactattcgttacgtttacctaaaacgttcggttaactacgttcgaccgtccgttcggggtaacccg

SEQ ID NO: 424620 - DNA, 558 bp, Homo sapiens
  misc_feature: GZ8MTXP01AZR92.44.27.C05.1.454.CMB.2.raw
  modified_base (301)..(301): a, c, t, g, unknown or other
  modified_base (505)..(505): a, c, t, g, unknown or other
  modified_base (538)..(538): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtatcaggtgcaattcgtggagtcgtgggggaggcgtggccccaggtagggggtccctgagactctcctgtgcagcctctggattcaccttcgataattggaatatgcagtggtccncaggctccaggcgagggggctgggagtggggtggcagggtgtgtcagtttccagttgggaggaaatcgaaaagttctaacgggtgaatttcccggttgacggggccgtattccacctatctccagagacaattccgaagaacacagtgtctcttacaaatgtaacacgcctgacgacctcacggacacggccgtgtaattttgngcgagtactattcgttgttaccaaatcggttcngtcgacgtccgttgggcccg

SEQ ID NO: 424621 - DNA, 647 bp, Homo sapiens
  misc_feature: GZ8MTXP01AX4TA.44.27.C05.1.454.CMB.2.raw
  modified_base (310)..(310): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctggagactctcctgtgcacgcctctggacttcaccttcgaataattggaatatgccagtcgggtccnccaggctccgaggcgaggggctgggagtgggtgcgaggtgtgtcatttccagttgggaaggaaatcgaaaaggttctaacgggtgtaacgtttcccggttggagggtcccgaatttcccacctatcctaccaggaacgaacgtaaacgttacccgaaggaaccaacgtagtacgttacttacttaacgaaattacggaaaccacggtaccctacggaacaccgtacgacggacgtaaccggtcccgttagttaacgttttggttcgccgagtacttattccttaggtttacccaaattccggttaactaacgttcgacgtccgttcggggaacccgg

SEQ ID NO: 424622 - DNA, 568 bp, Homo sapiens
  misc_feature: GZ8MTXP01BSE0K.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (282)..(282): a, c, t, g, unknown or other
  modified_base (314)..(314): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcacgtgganccagcggtaatnttcttagtcttaactttgctctgtatcaacatcatccaaggtaaacnccccaaactcatcatctatgagcctaataagngccctcgtagggtttctaatcgcttcacctcgacccaagtccgacaaaccaccggccctccctgaccaactctctcgggctccgaggctaggaggacgagctagtatttattattgttgactcgagtacttgttcgtcactatctactttatgttcgttacggaaggttcgggaaccgtaaggttcctacccggttcgtacggtacacgcccacggaacccaaccctaactcgtcacctcgttccgttcccccg

SEQ ID NO: 424623 - DNA, 584 bp, Homo sapiens
  misc_feature: GZ8MTXP01EF2GW.44.27.C05.1.454.CMB.2.raw
  modified_base (314)..(314): a, c, t, g, unknown or other
  modified_base (584)..(584): a, c, t, g, unknown or other
tcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgtgaggccattcacatctcagagacaattccgagaacacagtgtctcttacaaatgaacagcctgagacctcgagacacggccgtgtattttgngcgagtactatcttgtttaccaaaattcggttcattccgacgcgtggggcccacgggaaaccctggtcaccgtctccgtcggcctccacacgggcccacgtccggtcctccccgtggcccgcccctcgcctccgaggacgccacctcccgaggacgccacgacggtcccgccccgtgggcctcgcccgtggtaccaaacggtccttaacgtttcccttaattacttacgtgtcttgttcggccgggctgggcaagggcgacaagttaagn

SEQ ID NO: 424624 - DNA, 539 bp, Homo sapiens
  misc_feature: GZ8MTXP01DAENI.44.27.C05.1.454.CMB.2.raw
  modified_base (223)..(223): a, c, t, g, unknown or other
  modified_base (322)..(322): a, c, t, g, unknown or other
  modified_base (365)..(365): a, c, t, g, unknown or other
  modified_base (496)..(496): a, c, t, g, unknown or other
  modified_base (516)..(516): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgccccaaactcatcatctatgagctaataagaggccctnaggggtttctaatcgcttcacctcgcctcaacgtccgacaacncggcctcctagacaatctctcgggctccaggctgaggacgagctgattattattgtagctcgagtattgttcgtcgctatctaacttatgtcgtcggaagtgggaccaaggtccaccgttccgtggttacncgacccaacggcccaacccnctcgttctaacgttccgttcccg

SEQ ID NO: 424625 - DNA, 685 bp, Homo sapiens
  misc_feature: GZ8MTXP01B0LXX.44.27.C05.1.454.CMB.2.raw
  modified_base (302)..(302): a, c, t, g, unknown or other
  modified_base (337)..(337): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcaggtggtccncaggctccgaggcgaggggctgggagtgggtgcgnggtgtgtcatttccgagtgggaggaaatcgaaaagttcgttaacgggtgtacgtttcccgggttaggacggggtccgtatttcccgacctactcctacccgaagtacgtaactaaacgttacccggaacgaaaccacgacgtacgttaccttactttaccgtaaagttacggaaaccacggtaccctacggaccgtaccctacgacgggtaaccgtaccgggtcccggttggtttaacgtttttcggttggtccggttaagtacgttaactttaccgttcgttttaccgtaaaacgttcgggtttaacctacgtttccggaccggtcccggttcgggggtaaccccgg

SEQ ID NO: 424626 - DNA, 600 bp, Homo sapiens
  misc_feature: GZ8MTXP01E3LMI.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcaggtgggtccgccaggctccgaggcgaggggctgggagtgggtggcgaggtgtgtctagtttcagtggaaggaaatcgaagttcgtacgggtgacgtttccggtggacggggtccagttcaccactctaccagagaacaagttaccgagaaacacagtcgtctcttacaaatgaacagcctagacgacctcgaggaaccgacggtccgtggtttacttttggtcgttcgaagtacttacgttcttacgtttaacctaaacgtttccggttactacgttaccggtaaccggttccggtaaccggggg

SEQ ID NO: 424627 - DNA, 650 bp, Homo sapiens
  misc_feature: GZ8MTXP01EHVIF.44.27.C05.1.454.CMB.2.raw
  modified_base (266)..(266): a, c, t, g, unknown or other
  modified_base (408)..(408): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggagcggtggccccgaggtacgggggtccctgagctctcctgtgcagcctntggattcaccttgataagttaggaatatgcgaggtcgggtccgccgaggcctccgagggcggagggggctgggaggtgggggtggcgaggttgtgtctagtttccgagtaggaaggaaactcgaaaaggttcctaacgggtntacgtttccggtaggaccggggctattccaccgtactctaccgaagacgaactaacgttaccgaacgaacacgtacgtacgttacttacgttaactaaagttacgaaacgacgaccgtagaaccgtaccgtacgacggtaccgtaccggtccgttagttaagtttgttgtacgttagtactacttcgttcgttaacctaagttcgttaacgtacgtccgaccgtccggttcgggtaacccgg

SEQ ID NO: 424628 - DNA, 621 bp, Homo sapiens
  misc_feature: GZ8MTXP01DN3UO.44.27.C05.1.454.CMB.2.raw
  modified_base (307)..(307): a, c, t, g, unknown or other
  modified_base (555)..(555): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtggttttcctcgttgccctcttaagaggtgtcatgtgtcaggtgcaattcgtggagtcgtgggggagcgtggccccgaggtacggggggtccctgagactctcctgtgcagcctctggattcaccttcgataaattggaatatgcgagtcgggtccnccgaggcctccgaggccggagggggctgggaggtggggtggcgaggttcgtgtctagtttccagtggaaggtaaatcgaaaagttctaacgggtgtacgtttcccggttggacggggtcctattccacctactctaccgagaacgactaaacgttaccgaagaacacgtagtcgttaccttacttacgaaatggaaaccaggcctagacgacctacgacggacgtaccggccgttgttaagttttggngtccgagtacctattcgttcgtttaccaaagtttcggtctagtccgacgttccgcggggtaacccg

SEQ ID NO: 424629 - DNA, 717 bp, Homo sapiens
  misc_feature: GZ8MTXP01AXQDM.44.27.C05.1.454.CMB.2.raw
  modified_base (317)..(317): a, c, t, g, unknown or other
  modified_base (327)..(327): a, c, t, g, unknown or other
  modified_base (336)..(336): a, c, t, g, unknown or other
  modified_base (340)..(340): a, c, t, g, unknown or other
  modified_base (353)..(353): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttgataattggaatatgcagtgggtccgccaggctccgaggcgaggggctgggagtggggtggcaggtgtgtcatttcagtggagaaatcgaagtcacggtgattccggtgagggccattcacatctcaganacaatccganaacacagtntctntacaaatcgaacngccctagacgtaaccctacgaacggaccaccgggtcctttaggtttaatttttgggcgtacgtagtaacttattccttagtttaaccaaaagtttccggttactaacgtttcccggaaccggtcccggtacgggggacccgtaaccggggtaaccccgttcgggtacccgtacccggttccccgttccccgtcccgggaccccttacccggaacccgtaaaccggggtcccctaaccggttcccgggttccccttcccccggtcgggccccgtccccttcggtcccgtcccggacgggttccgacccgtaaccccgtacccggaacggacgaccgaaccggccgggttcccgggtaaccccggg

SEQ ID NO: 424630 - DNA, 728 bp, Homo sapiens
  misc_feature: GZ8MTXP01EPAOM.44.27.C05.1.454.CMB.2.raw
  modified_base (291)..(291): a, c, t, g, unknown or other
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggaggcgtggccccgaggtacgggggtccctgagactctcctgtgcagcctctggattcacttcgataatgaatangcagtggtccncaggctccgaggcgagggctgggagtgggtgcgaggtgtgtcagtttccagtgggaaggaaatcgaaaagttctaacgggtgtaacgtttcccggttaggacggggtcccgtaatttacccgaccctaactcctacccgaaggaacgaacctaaaacgtttacccggaaagtaaaccaaccgagttagttaccttacctttaccgaaaattacgaaaaccgtacgtacccgttacggaacgtaacccgttaccgaacgggtaccgtaaaccgggtcccgtttaggtttaacgttttttaggttcggtacggttaacggtaacctttaagttaccgtttacgttttaaccccgtaaaaacgtttccgggtttaacctaacgttttaccgggacccggttcccgggttaaccggggggtaaccccggg

SEQ ID NO: 424631 - DNA, 635 bp, Homo sapiens
  misc_feature: GZ8MTXP01ETHSB.44.27.C05.1.454.CMB.2.raw
  modified_base (264)..(264): a, c, t, g, unknown or other
  modified_base (304)..(304): a, c, t, g, unknown or other
  modified_base (368)..(368): a, c, t, g, unknown or other
  modified_base (495)..(495): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctggggttttcctcgttgccctcttaagaggtgtcatgtgtcaggtgcaattcgtggagtcgtgggggagcgtggccccaggtagggggtccctgagactctcctgtgcagcctntggattcacttcgataattggaatatgcaggtcgggtccnccgaggctccgagggcgaggggctgggagtgggtggcaggtgtgtctagtttccagtggagaanctaagagtcgtagtagtacgttcggtaggacgcgtactacacgtactcgacagaacgaactacgtacgaagtaacatagttactacttaactaacaagtaacaacgacgtacgtacgaacgtaaccncgtaacgaccggtacccggttggttaattttcggtttggacgttacggtaaacttacgttactttcgtttaacccgttaaaccttaacggtttccgttacgtacgttacccgggtccggttaaccggggtaaccccgggg

SEQ ID NO: 424632 - DNA, 598 bp, Homo sapiens
  misc_feature: GZ8MTXP01AP793.44.27.C05.1.454.CMB.2.raw
  modified_base (345)..(345): a, c, t, g, unknown or other
  modified_base (362)..(362): a, c, t, g, unknown or other
  modified_base (371)..(371): a, c, t, g, unknown or other
  modified_base (398)..(398): a, c, t, g, unknown or other
  modified_base (547)..(547): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccaggcggaggggcgtggaggtgggtggcgaggtgtgtcatttcatggagaaatcaagtcgtacggtgattccgttggagggccgattcaccatctccagagacaattccgagaacacagtgtctntcaaatgaacagcctanagaaccctnaaggacaccggtcgtgttatttttagngtcgagtactatcttagtttaccaaaagttcggttactattcgacgtccgtcgggtccgacgggtaacccgtggtcgaccgtctcctcggccctccaccgaacgggccctagtccgtccttcccccgtcggccggtccccttacgtccncccgacggacgccaacccgtcggaacgacggcaccgaacggcccggcccgg

SEQ ID NO: 424633 - DNA, 701 bp, Homo sapiens
  misc_feature: GZ8MTXP01AGJPA.44.27.C05.1.454.CMB.2.raw
  modified_base (320)..(320): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactccaccatggagtttgggctgagcttgggttttcctcgttgccctcttaagaggtgtcatgtgtcaggtgcaattcgtggagtcgtgggggaggcgtgggccccgaggtacggggggtccctggacgactctcctgtgcagcctcgtggacttcaccttcgaataagttggaatatgcaggtgggtcccncgaggcctcgaggcggaggggctgggagtggggtggcgtagggtgtgtctatttcgagtggaaggtaaatcgaaagttcgtacgggtgtaacgttcggtggacgggtcctacttccaccactcctaccgaagacgaactaacgttaccgaagaaccactagtacgttacctacttacgaaaagtcgaaacgacgtacccgtaggaaccgtaacccgtacgaacggtaccgtaccgggtcccggttaaggtttaacgtttttggtacggttacggtaacggttaacctttacgttaccgtttaccgtttaaacccgttaaaacggtttcccggtttaacgtaacgtttcccggtaaccggttcccgggttaaccccgggggg

SEQ ID NO: 424634 - DNA, 563 bp, Homo sapiens
  misc_feature: GZ8MTXP01CKOYG.44.27.C05.1.454.CMB.2.raw
  modified_base (283)..(283): a, c, t, g, unknown or other
  modified_base (321)..(321): a, c, t, g, unknown or other
  modified_base (359)..(359): a, c, t, g, unknown or other
  modified_base (368)..(368): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccagtaaacncccccaaactcatcatctatgagcctataagagccctnagggtttctaatcgcttcacctgctcagtccgacaacncgcctcccngacatctctggctcagctgagcgagctgattattattgtgctgagtattgttcgtcgctatctactttatgttcgtttcgggaaaggttcggggaaacccttaagggttcccacccggttacccgtagggttacccacgaccccgaaagggaccccaacccctacttcgttaccctaaccgttcctttaaccccg

SEQ ID NO: 424635 - DNA, 797 bp, Homo sapiens
  misc_feature: GZ8MTXP01DKOY2.44.27.C05.1.454.CMB.2.raw
  modified_base (362)..(362): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacggggggtccctggagactctcctgtgcagcctctggattcaccttgataattggaatatgcaggtcgggtccgcaggcctccgagggcggagggggctgggaggtgggggtggcgtaggttgtcggtntagttttccgagtagggaagtaaactcgaaaagttcgtaacgggtgtacgttccgggttaggacgggtccgtattacccgaccctagtacctaccgaaggtaacgaaaccgtaaacgttacccggaaacgtaaaccgaacgtaacgggttacgttaccgtttacccgtttaaacgtaaaaacgttacggtaaaaccgtacggtacccgttacggaaccgtaacccgttaaccggaacgggtacccggtaccggggttacccggtttaggttttaaggttttttcggacgggttaccggaaacgtttaaccgtttaacgttttacccgtttacggttttaaaccccgttaaaaacggtttcccggggtttaaccttaaacggtttcccgggttaaacccgggttccccggggttaaccggggggtaacccccgggg

SEQ ID NO: 424636 - DNA, 861 bp, Homo sapiens
  misc_feature: GZ8MTXP01DXZA2.44.27.C05.1.454.CMB.2.raw
  modified_base (215)..(215): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccaggtaggggggtccctgagactctcctgtgcagcctctggattcaccttcgataattggaatatgcagtgggtccnccaggctcaggcgagggctggagtgggtgcaggtgtgtcatttcagtggaaggaaatcaaagtctacggtgattccggtagacggggcctaattccaaccatcctaccgaagacgaaactaaacttccggaaagaaacctaacgtaggttcttaccttacctttaacaaaaattccggaaaaccacgtaccccgttaggaacctaaaccccgttacgaacggggaacccaacccggggtcccgtttaggttttaattttttcgggacggaccggtaagtaaccctttaattaccgttacgttttaacccgtaaaaagtttccgggtttactaacgtttcccggaacccgtaccgggttacgggggtaacccgaaccggggtaaaccccggtttcggggtaccccttaaacccggttcccgttccccggtcccgggtcccccttaaccccgaaaccccgggaaacccgggggtcccccctaacgttcccccggggtttcccccttcccccccggttcgggcccccgggtccccctttcggccccgttaaccccgggaacggttaccccggttacccaaacccccgttacccggaaccgggaacccgacccgaaacccggtaacccgggcccccggggttcccccggg

SEQ ID NO: 424637 - DNA, 680 bp, Homo sapiens
  misc_feature: GZ8MTXP01EROTG.44.27.C05.1.454.CMB.2.raw
  modified_base (608)..(608): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaagttcgtggagtcgtgggggaggcgtcgggcccccgagggtacgggggtccctggacgactctccgtgtgcagcctgtggtattcaccttgataagtggaatatgcaggtcgggtcccgccgaggcctccgagggcggaggggcgtgggaggtgggggtgcgtaggtgtgtctatttcgagtgggaagtaaatcgtaaagtcgttacgggtgtaacgtttccgggttagggaccgggtaccgtatttccgaacctacgttcctaccgaagtaacgaaacctaaacgttacccgaagtaaacaccgtagttacgtccttacgttaactaaagttacgaaacgtaccgccgttacgaacgaacccgtacgaacggaccgtaccgggtcggttaaggtttgtttacggngttacgtacgtacgttacgttccgttacgttaactacgttcgtacgtacgttaccggtcggttccgggtcgg

SEQ ID NO: 424638 - DNA, 618 bp, Homo sapiens
  misc_feature: GZ8MTXP01B2VG8.44.27.C05.1.454.CMB.2.raw
  modified_base (537)..(537): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagactctctgtgcagcctctggattcacttcgataatggaatatgcaggtcggtccgccaggcctccgagggcggagggggctgggaggtggggtggcgtaggtgtgtctagtttcagtggaagaaatcgaaagtcgtaacggtgtacgtttccgttgagtcgggacctagttcacctactctaccagacgaactaacttaccgaacgaacacgtaagtcgtccttacttactaaagtacgaaacacgtccgtcgacgaccgtacgacggaccgtaccggtccgttggttnttttagtcgttacgtagtacttattcttacgttaacctaaacgtcgttactacgttccggtaaccgttccggtaaccgggg

SEQ ID NO: 424639 - DNA, 602 bp, Homo sapiens
  misc_feature: GZ8MTXP01BQBMC.44.27.C05.1.454.CMB.2.raw
  modified_base (389)..(389): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctgattcaccttgataattggaatatgcaggtggccgcaggctccgaggcggaggggctggagtggggtgcgaggtgtgtctatttcagtggaggtaaatcgaaagtctacggtgattccggtgacggccattcaccatcnccagagacaatcgagacacagtcgtctacttacaaatagaacagcctagacgaccgtcgaacggaccaccgggtccgttgttagttttggtcgtcgtagtacttattctaacgtttaaccttaaagttcggttactacgttcgacccggttcgttcggggaacccgacggggtaacccgtcgggtcccgttacccgtcccgttcccgtcccgg

SEQ ID NO: 424640 - DNA, 592 bp, Homo sapiens
  misc_feature: GZ8MTXP01DKHW7.44.27.C05.1.454.CMB.2.raw
  modified_base (303)..(303): a, c, t, g, unknown or other
  modified_base (386)..(386): a, c, t, g, unknown or other
  modified_base (524)..(524): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataattggaatatgcagtgggtccnccaggctccgaggcgaggggctgggagtgggggtggcaggtgtgtcagtttccagtggaggaaatcaaaagttctaacgggtntacgtttcccgggttagacggggtccgtagttccaccctatcctccaagagaacaaacttccgagaacacagtgtctacttacaaatagaacagcctgacgacctacgacggtacgaccggtccgttgttaattttgngtacgagtactattcgttcgtttaccaaaagttcgttctacgttcgaccgtccgttcggggaacccgg

SEQ ID NO: 424641 - DNA, 553 bp, Homo sapiens
  misc_feature: GZ8MTXP01EORU9.44.27.C05.1.454.CMB.2.raw
  modified_base (223)..(223): a, c, t, g, unknown or other
  modified_base (234)..(234): a, c, t, g, unknown or other
  modified_base (264)..(264): a, c, t, g, unknown or other
  modified_base (266)..(266): a, c, t, g, unknown or other
  modified_base (280)..(280): a, c, t, g, unknown or other
  modified_base (361)..(361): a, c, t, g, unknown or other
  modified_base (440)..(440): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatnttcttagtcttaacttgtctctgtatcaanancatccaggtaaacnccccaaactcatcatctatgagctaataagagccctgtagggtttctaatcgcttcacctgcctcgaacgtccggacaacnccggcctcctgacaatctcgcggctcgagctgaggacgagctgactttattagttgttgctacgagtattgttcggtcnctactctactttatgttcgttacggaagtcggaacttaggtccttaccgtctacgttacgacgacccgtaacggaccccaaccctcgtcgttacctaaccgttccgttccccg

SEQ ID NO: 424642 - DNA, 724 bp, Homo sapiens
  misc_feature: GZ8MTXP01BY0F2.44.27.C05.1.454.CMB.2.raw
  modified_base (251)..(251): a, c, t, g, unknown or other
  modified_base (374)..(374): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacgggggtccctgagactctcctgtgcagcctntgattcacttgataattgaatatgcaggtcgggccgccaggctccgagggcggaggggctgggaggtggggtggcgagggtgtgtctatttcagtgggaagaaatcgaaagtcgtaacgggtntagtttcccggtaggacggggtacccgtaatttcccgaacctacttccgtacccaaagtacggtaaacctaaacgttacccgaaagtaaaccaacgtaacggttcttaccttaacctttacaaaaacgttacgaaaaccgtacgacccgtaggaaccggtacccgtacgaaacgggtaccgtaaccgggttccgttagtttagtttttggcgtacgtaagtacttacttacttaacgtttaaaccgaaaacgttcggttactacgttcggttaaccggttccggttacgggggaaccgtaaccgggtaaccccgttgggtacccttacccggtccgttcccgtccccggg

SEQ ID NO: 424643 - DNA, 585 bp, Homo sapiens
  misc_feature: GZ8MTXP01AG2HA.44.27.C05.1.454.CMB.2.raw
  modified_base (300)..(300): a, c, t, g, unknown or other
  modified_base (516)..(516): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataattggaatatgcagtcggccncaggctccgaggcgaggggctgggagtgggtgcgaggtgtgtctatttcagtggaagaaatcaaagttctaacggtgtacttccgggttagacggggcctattccacctatcctaccgagacaactaacgttccgaagaacacgtagtcgtactacttacaaatagaacacgcctgacgacctacgacggaccgaccggtccgttgttaagtttgngtacgagtactagttcgttgttaccctaaagttcggttaactacgttcgacgtccgttcggggaacccg

SEQ ID NO: 424644 - DNA, 611 bp, Homo sapiens
  misc_feature: GZ8MTXP01EI6A5.44.27.C05.1.454.CMB.2.raw
  modified_base (268)..(268): a, c, t, g, unknown or other
  modified_base (288)..(288): a, c, t, g, unknown or other
  modified_base (299)..(299): a, c, t, g, unknown or other
  modified_base (537)..(537): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggagcgtcggccccgaggtacgggggtccctgagactctcctgtgcagcctntgattcacttgatatgatangcagtggtccncgagcctcgaggcgagggctgggaggtgggtggcgaggtgtgtctatttccgagtggaagaaatcgaaaagttctcggtgtacgtttccggtggacgggtccgtattacccacctatcctaccgagaacgaactaaacgttaccgaagaaccaacgtacgtcgtacttacttaacaaactacgaaacacgaccgtagacgaccgtacgacggtacgacggtccgttgttaacttttgngtcgttagtacttattacgttcgttaactaaagttcgttaactacgttaccgacggtcccgttcggggaacccg

SEQ ID NO: 424645 - DNA, 682 bp, Homo sapiens
  misc_feature: GZ8MTXP01AYZL0.44.27.C05.1.454.CMB.2.raw
  modified_base (303)..(303): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctctggattcaccttcgataattggaatatgcagtggtccncgaggctccgaggcgaggggctgggagtggggtggcgaggtgtgtctatttccgagtggaaggtaaatcgaaaagttcgtaacggtgtacgttcccgggttgacggggtcctattccacccgtattcctaccaaggacgtaactaaacgttacccgaagaaaccacgtacgttcgtacttacttaacgtaaaagttacgaaacacgtacccttaggacgtaacccgtacgaacgggtaccgtaccgggtcccggtttgtttaagtttttcggttcggtaccggttacgtaaccgttactttaccgtttcgtttaacccgtaaaacgttccggtttaaccgtacgttccggaacccggtcccgttcgggggtaaccccgg

SEQ ID NO: 424646 - DNA, 795 bp, Homo sapiens
  misc_feature: GZ8MTXP01BDRYC.44.27.C05.1.454.CMB.2.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaactttgtctctggtatcaacatcatccaagtaaacgcccccaaactcatcatctatgagcctaataagacggccctcgtagggtttactaatcgcttcaccctcgacctccgaaacgtcccggaacctaaacccgaaccggtccctaccccgtagaaccctaaacgttcctcgtcggggtcccttaccggaacgggtccgtagggaacgggaaccggtaacggggtacctttaggttaaatttttaagtttaacgttttgggtttaacggtccttaccgggttaaaggttaacggtttttccgggtttacccgggttccgtaacccttaagtttaccccgttaaatttttaaccgttcgggttttaacccggttttaccgggggtaaaacggggttaacccgggggtaaaaccccgttaaaacgggggttccccgttaaccccgggtttacccgttaacgggttcccgaaccggttaacccccgaaaaccgggtacccccaaaccccgtacgttaccggttaccctaacccgtttcccgtttcccccgg

SEQ ID NO: 424647 - DNA, 568 bp, Homo sapiens
  misc_feature: GZ8MTXP01EC1WV.44.27.C05.1.454.CMB.2.raw
  modified_base (451)..(451): a, c, t, g, unknown or other
  modified_base (497)..(497): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataatggaatatgcagtggtccgccgaggctccgaggcggagggggctgggagtggggtggcgtaggtgtgtctatttcagtggaagaatcgaagtctaggtgtattccgtgagggctatcactatctcagagactaattccgaagacacagtcgtcttactactaaatanaacgagccgtagacgacctcgaggacacggccgtgttagttttggngttcgaagtacttacgttcttacgttaacctaaaagttcggttctagttccgtaacgttccgtaaccgggg

SEQ ID NO: 424648 - DNA, 636 bp, Homo sapiens
  misc_feature: GZ8MTXP01ETTB8.44.27.C05.1.454.CMB.2.raw
  modified_base (270)..(270): a, c, t, g, unknown or other
  modified_base (305)..(305): a, c, t, g, unknown or other
  modified_base (555)..(555): a, c, t, g, unknown or other
  modified_base (573)..(573): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggcccccgaggtagggggtccctgagactctcctgtgcagcctntggattcacttgatatggaatatgcagtcggtccncaggctccgaggcgaggggctgggaggtgggtggcagggtgtgtctatttcgagtggaggaaatcgaaagtcgtacgggtgtacgttccgttagacggggtcctattcgactatcctacgagagaactaagttaccgaagaaccacgagttacgtccttacgttaacctaaagttagaaaccaggtacccctaggaaccgaacccgtcgaacggaaccgtaccgggtccgttaagtttaacgtttttggngttacgtagtaaccgttnttccgttacgtttaacctaaagttccggttactagttaccggtaaccgttccggtaaccgggg

SEQ ID NO: 424649 - DNA, 634 bp, Homo sapiens
  misc_feature: GZ8MTXP01EFPZZ.44.27.C05.1.454.CMB.2.raw
  modified_base (190)..(190): a, c, t, g, unknown or other
  modified_base (224)..(224): a, c, t, g, unknown or other
  modified_base (235)..(235): a, c, t, g, unknown or other
  modified_base (266)..(266): a, c, t, g, unknown or other
  modified_base (268)..(268): a, c, t, g, unknown or other
  modified_base (379)..(379): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaactttgtctctgtatcaanancatccaagtaaacaccccaaactcatcatctatgacgacctaagtaagacggcccttagtagggtttactaatcgtcttcacctcgcctaccaacgtcccggaaccaaccnccggccctaccctacgaactaactctcgtcgggctccgaggctaggaggacgaggtctagtatttattagttgttacgtctcggtagtatttcgttcggtctctacttctaactttagtcgtttaccgtacggtaacgggtaacgggtaaaccttaaacgggttccttaccgttaccgttaaggttaccgacggaccccgaacgggaccccctaaccccgtactccggttacctaaccgttccgtttaacccccg

SEQ ID NO: 424650 - DNA, 651 bp, Homo sapiens
  misc_feature: GZ8MTXP01C59FK.44.27.C05.1.454.CMB.2.raw
  modified_base (333)..(333): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccagtagggggtccctgagactctcctgtgcagcctcgtggattcacttcgatatggaatatgcagtggtccgccaggctccgaggcgaggggctggaggtgggnggcaggtgtgtctatttcgagtggaagtaaataacaagtcgtaaacgggtgtagtttcccggttaggacgggggaccctaagttcctaccaactcctaccgaagaacgaaacctaaacgtttaccgaacgaaacctaacaacgttacgttaccttacgtttactaaactagaaaccacggccctacgacgaacctcgtaacggaaccgaccgggtccgttggttaacgtttttggtacggaccgtaggtaacttacttcgttacgtttaacctaaaacgttcggttacctagttccgtaacgttccggtaaccggggg

SEQ ID NO: 424651 - DNA, 620 bp, Homo sapiens
  misc_feature: GZ8MTXP01EV8UP.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctctggattcaccttcgataattggaatatgcaggtcggtccgccgaggcctccgagggcgagggggctgggagtggggtggcgaggtgtgtcatttccagtggaggtaaatcaaaagtctaacgggtgtacgtttccgtggacgggtcccgtattccaccgtatcctaccgagacgaactaacgttaccgaagaaaccacgagtcgtactacttacgaaattcgaaacacgcctagacgtacctacgacggtaccgacggtccgttgttaattttcggcgtcgacgtacgtacttcgttcgtttaacctaaagttcgttaacgtacgttccggaccgtccggttcggggtaacccgg

SEQ ID NO: 424652 - DNA, 608 bp, Homo sapiens
  misc_feature: GZ8MTXP01EDN0C.44.27.C05.1.454.CMB.2.raw
  modified_base (342)..(342): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctctggattcaccttcgataattggaatatgcagtggtccgccaggctccaggcgaggggctgggagtgggtggcaggtgtgtcntttcatggaggaaatcaaagtctaacggtgaacgtttccggtggacgggccgattcgaccatctccagagacaaacgttaccgagaacacagtgtctcttacaaactgaaacagcctgacgacctacgacggtaaccgacgggtcccgttggttaacgtttttggttggtaccgttaggtaacgttacttacgttacgtttacccgtaaaaagttcgggtttaacctacgtttccggaaccggtcccgttcgggggtaaccccggg

SEQ ID NO: 424653 - DNA, 588 bp, Homo sapiens
  misc_feature: GZ8MTXP01ASFWF.44.27.C05.1.454.CMB.2.raw
  modified_base (307)..(307): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagctctcctgtgcagcctctggattcaccttgatatggaatatgcaggtcgggtccnccgaggctcgaggcggaggggctgggagtggggtggcgagggtgtgtctatttcagtggaagtaaatcaaagtctagggtgtacgttccggttgacggggctattcacatctaccagacgacaacttaccgaacgaacacagtcgtacttacgtacaaatcgaacagccgtagacgacctcgacgacgaccggtccgtgttacgttttggcgttcgtacgtacttacgttcttacgttaacctaaagttcgttactacttcggaaccgttccgtaacgggg

SEQ ID NO: 424654 - DNA, 578 bp, Homo sapiens
  misc_feature: GZ8MTXP01A81MY.44.27.C05.1.454.CMB.2.raw
  modified_base (189)..(189): a, c, t, g, unknown or other
  modified_base (233)..(233): a, c, t, g, unknown or other
  modified_base (264)..(264): a, c, t, g, unknown or other
  modified_base (384)..(384): a, c, t, g, unknown or other
  modified_base (470)..(470): a, c, t, g, unknown or other
  modified_base (556)..(556): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctggtcncctggacagtcgtcaccatctcctgcactggagccagcgtaatnttctagtcttaacttgctcctgtatcaacancatccagtaaacgccccaaactcatcatctatgagcctaataacgacgccctgtacggggtttactaatcgcttcacccttcggacctccaaacgtcccggaacaaccgcggccctcccngaccaatctctcgggcttcccgaggctggacggacgaggctagattattagttgttgcttgagtatgtcgtcgctatcctaaattntcggttctttaacgggaaggttgggaaccgaaagggtccaacccggttcgtaacgggttcaccgacccgaacggccccaaaccccngtcgcctaaccttcgttccccg

SEQ ID NO: 424655 - DNA, 555 bp, Homo sapiens
  misc_feature: GZ8MTXP01C5Z8F.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccaccaggctccaggcgaggggctgggagtggggtggcaggtgtgtcatttccatggaggaaatcaaaagtctaacggtgaattccggttgaggggcccgattcaccatctccagagacaattccgagaacacagtgtactcttacaaatgaaacagacctgacgacctacagacacggccgtgtaattttgttgcgagtacgtattcgttgttacctaaaatcggttcacttcgacgtcccgttggggtaacccg

SEQ ID NO: 424656 - DNA, 540 bp, Homo sapiens
  misc_feature: GZ8MTXP01BAICP.44.27.C05.1.454.CMB.2.raw
  modified_base (224)..(224): a, c, t, g, unknown or other
  modified_base (235)..(235): a, c, t, g, unknown or other
  modified_base (269)..(269): a, c, t, g, unknown or other
  modified_base (283)..(283): a, c, t, g, unknown or other
  modified_base (365)..(365): a, c, t, g, unknown or other
  modified_base (373)..(373): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatnttcttagtcttaactttgtctctggtatcaacancatccaggtaaacncccccaaatcatcatctatgaggcctaataagacggccctgtaggggtttctaatcgcttcacctgctcacgtccgacaacncgcctccngacatctctggctcaggctggagacgagctagtattattattgttgctcgagtattgtacgtcgctatctactttatgtcgttacggaaggtcgggaaccttaaggtccaccggtcctagggttccacgcccaacggtcccaacccactcgctaaccgttcttcccg

SEQ ID NO: 424657 - DNA, 598 bp, Homo sapiens
  misc_feature: GZ8MTXP01A5VIF.44.27.C05.1.454.CMB.2.raw
  modified_base (359)..(359): a, c, t, g, unknown or other
  modified_base (383)..(383): a, c, t, g, unknown or other
  modified_base (388)..(388): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgaataattggaatatgcagtgggccgcaggctccgaggcgaggggctggagtgggtgcgaggtgtgtcatttcatggagaatcgaagtctaccggtnattccggtgaggccattcacatcnccagnacatcgagaacacagtgtctactacaaatcgaacacgcctagacgaccgtacgaaggaccgaccgggtccgttgttagttttgtgcgtagtacttatcgttaacgtttaaccttaaaagttccggttacgtacgttccgaccggttccgttcgggggaacccgtacgggtaacccgttcggggtaccttacccggtccttcccgtcccgg

SEQ ID NO: 424658 - DNA, 598 bp, Homo sapiens
  misc_feature: GZ8MTXP01AXFAK.44.27.C05.1.454.CMB.2.raw
  modified_base (160)..(160): a, c, t, g, unknown or other
  modified_base (292)..(292): a, c, t, g, unknown or other
  modified_base (306)..(306): a, c, t, g, unknown or other
  modified_base (424)..(424): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtggttttccncgttaggccctcttaagaggtgtcatgtgtcaggtgcaattcgtggagtcgtgggggagcgtggccccaggtagggggtccctgagctctcctgtgcagcctcgtggacttcaccttcgataagttggaatntgcaggtcggtccncgaggcctccgagggcggaggggctgggaggtgggtggcgaggtgtgtctatttcagtggaagaatcaaaaggttctaaggtgtacgttcccggtgacggggtccctattccaccctntaccgacagacgtaactacgtacgaacaacacgacgtctactactacgtaatagacacgcgtcgacgaccgacgacgtacgtacgtcgttgttgttgttgtacgttacgtactacttcgttcgttacgtaacgttacgttcgtacgtacgttaccgtccggttcgggtaaccgg

SEQ ID NO: 424659 - DNA, 630 bp, Homo sapiens
  misc_feature: GZ8MTXP01BXLQH.44.27.C05.1.454.CMB.2.raw
  modified_base (265)..(265): a, c, t, g, unknown or other
  modified_base (303)..(303): a, c, t, g, unknown or other
  modified_base (451)..(451): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacgggggtccctgagactctcctgtgcagcctcnggtattcaccttgatatggaatatgcaggtcgggtccncgaggctccgagggcggagggggctgggaggtggggtggcgagggtgtgtctatttccgagtggaaggaatcgaaaagttctaagggtgtacgttccggtggacggggcctaagttccactactctacagacgacaacgttccggaanaaccacgaagtgtacctcttacaaactcgaacacgcctaggacgtacctacgacggaccgacggtccgttaggttaagttttcggttagtcgttaacgtacgttacttcgttacgtttaacccgtaaagttcgggttaacctacgttcccggttaccgtccggttcggggtaaccccgg

SEQ ID NO: 424660 - DNA, 579 bp, Homo sapiens
  misc_feature: GZ8MTXP01AG22U.44.27.C05.1.454.CMB.2.raw
  modified_base (289)..(289): a, c, t, g, unknown or other
  modified_base (300)..(300): a, c, t, g, unknown or other
  modified_base (505)..(505): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatangcagtcggccncagactccaggcgagggggctgggagtgggtggcagggtgtgtcatttccgagtggaagaaatcaaaagtctaaggtgtagttccggtgacgggcctattccaccatctacagacaacgtaactaccgaagaacacgtagtcgtactcttacaaagtcgaacagccgtgacgaccgtacgagtacgacggtccgtgttaatttgngcgttagtacgttattcgttcgttacgtaaacgttcgttaactacgttccggaccgtccgttcggggaacccgg

SEQ ID NO: 424661 - DNA, 555 bp, Homo sapiens
  misc_feature: GZ8MTXP01A6VX0.44.27.C05.1.454.CMB.2.raw
  modified_base (190)..(190): a, c, t, g, unknown or other
  modified_base (224)..(224): a, c, t, g, unknown or other
  modified_base (235)..(235): a, c, t, g, unknown or other
  modified_base (362)..(362): a, c, t, g, unknown or other
  modified_base (370)..(370): a, c, t, g, unknown or other
  modified_base (378)..(378): a, c, t, g, unknown or other
  modified_base (431)..(431): a, c, t, g, unknown or other
  modified_base (441)..(441): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaactttgtctcctggtatcaacatcatccaggtaaacgcccccaaaatcaatcatctatgaggcctataagagccctgaggggtttctaatcgcttcactgctcagtccgacaacncgcctccngacatctntggctcaggctgagagaggctgattattatgtgctcgagtagttgtcgtcacntctaaacttntgtacgttacggaaggtcggtaacgttaacggtccaccggttacccgtaggttaccgacgaccccgaacggcccctaaacccctcgtacgttccctaaccgttccgttccccgg

SEQ ID NO: 424662 - DNA, 584 bp, Homo sapiens
  misc_feature: GZ8MTXP01AGG5Y.44.27.C05.1.454.CMB.2.raw
  modified_base (223)..(223): a, c, t, g, unknown or other
  modified_base (234)..(234): a, c, t, g, unknown or other
  modified_base (317)..(317): a, c, t, g, unknown or other
  modified_base (360)..(360): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatnttcttagtcttaattgtctcctggtatcaacatcatccagtaaacgcccccaaactcatcatctatgagctataagagccctntagggttctaatcgcttcactcgctccaacgtccggacaaccncggccctccctagacaatctcgtggctccgaggctggaggacgagggctagattatttattggttagtctacgagtagttgttcgtcgctatctacttatcgttacgttcgggtaaggtggggaacccttaaagggtccacccggttacccgttaacgggttccgacggccccgaaacgggccccaaccccctaagtccgttacctaaccttccgttccccggg

SEQ ID NO: 424663 - DNA, 765 bp, Homo sapiens
  misc_feature: GZ8MTXP01AG0EG.44.27.C05.1.454.CMB.2.raw
  modified_base (265)..(265): a, c, t, g, unknown or other
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtgggccccaggtacgggggtccctgagactctcctgtgcagcctcnggattcaccttgataatggaatatgcaggtcggtccnccaggcctccgagggcgaggggctgggagtgggtggcgagggttgtcgtctattttccgagttgggaaggtaaactcgaaaaaggttccgttaacgggttgtaaccgtttcccggttaggaacgggggtccctaatttcccaacccgtattcctacccgaaggtaacgaaccgtaaacgttaccccggaaagaaacccgtaacgtaacggttcggttacccttaccgtttaaccgaaaagttaccgaaaccgaccgggtaccccttaggaaccgttaccccgtacggaaacggacccggtaaaccgggtcccgtttggtttaaagttttttcggcggtaaccggttaaacggttaaacccgtttagtttacctttacgggtttaaaccctaaaaggttttccgggttaaccttacggtttacccgggaccggttaacccggttaaccgggggtaacccccggg

SEQ ID NO: 424664 - DNA, 632 bp, Homo sapiens
  misc_feature: GZ8MTXP01DYG5S.44.27.C05.1.454.CMB.2.raw
  modified_base (353)..(353): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccgaggtacggggggtccctggagctctcctgtgcacgcctgtggattcaccttgataatggaatatgcaggtcggtccgccaggcctccgagggcggagggggctagggaggtggggtcggngtagggtgtgtcctatttcgagtagggaagaaatcgaaagttcgtagggtgtacgtttcccgtggacgggtcgtattccactatctccagaacgaacgtacttaccgaagaaccaactaggtatccttacgttaactaaactagaaaccagcccgtagacgaacctcgaggaccgtacggtccgtaagttagttttgtcgttacggtatacttacttcgtttacgttaaccctaaaattcggttacgtacgttaccgtaaccggttcgtaacccggggg

SEQ ID NO: 424665 - DNA, 666 bp, Homo sapiens
  misc_feature: GZ8MTXP01DG1S9.44.27.C05.1.454.CMB.2.raw
  modified_base (304)..(304): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggattcaccttcgataattggaatatgcaggtgggtccnccgaggctccgagggcggagggggcgtgggaggtgggggtggcgtaggtgtgtctagtttccagtgggaaggtaaatcgaaaagttcttaacgggtgtacgtttccggttaggacggggtcccgtattaccacctatacctaccgaagaacgaacctaaagttacccggaagaaaccaacgtagtacgttacttactttaacgaaaacttaggaaaccacgacccgtagaccgaccctacgacggtaaccgtacggtcccggttgtttaagttttgcggtaccgagttaacttacttcgttacgtttaacctaaaagttcggtttaactacttccggaccggtccggttcggggtaacccgg

SEQ ID NO: 424666 - DNA, 598 bp, Homo sapiens
  misc_feature: GZ8MTXP01DNUR9.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtcctcaggctccaggcgagggggctgggagtggggtggctagggtgtgtcatttccagttggaggtaaatccgaaaagttctaacgggtgaacgtttcccgggttagaacggggccgtatttaccgaccctaatcctccaagaacgaacaaattcccgaagaaacacagtgtactcttacaaatcgaaacacgacctgacgacctacgaggtacacggccgtgttaattttgttgcgagtacttagttcttgtttacctaaaagtcgttctagttcgacgtccgttcggggtaacccgg

SEQ ID NO: 424667 - DNA, 630 bp, Homo sapiens
  misc_feature: GZ8MTXP01DSV9S.44.27.C05.1.454.CMB.2.raw
  modified_base (262)..(262): a, c, t, g, unknown or other
  modified_base (269)..(269): a, c, t, g, unknown or other
  modified_base (271)..(271): a, c, t, g, unknown or other
  modified_base (287)..(287): a, c, t, g, unknown or other
  modified_base (297)..(297): a, c, t, g, unknown or other
  modified_base (320)..(320): a, c, t, g, unknown or other
  modified_base (336)..(336): a, c, t, g, unknown or other
  modified_base (487)..(487): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcgaggtgcaattcggtggagtcgtggggggagcggtcggccccgaggtacgggggtccctgagactctctgtncagcctngnttcactgatatgatangcagtggccncaggctcgaggcgagggctgggngtgggtgcgaggttgngtcagtttccagtaggaagaatcgaaaagttctaacgggtgtaacgttccggttggacggggtccctatttacccgaccctattccaccgagacgaactaaacgttcccgaaagaaacacgagttctacttacttaacaaattggaaaccngaccttagacgtaccgtaacgacggtaccacggtccggttatttaagttttcgttaggccgttaagtaaccttagttcttacgtttaaccctaaattccggtttcacgtttccggaacggtcccggttcggggtaaccccggg

SEQ ID NO: 424668 - DNA, 707 bp, Homo sapiens
  misc_feature: GZ8MTXP01AF003.44.27.C05.1.454.CMB.2.raw
  modified_base (273)..(273): a, c, t, g, unknown or other
  modified_base (311)..(311): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacggggggtccctggacgacctctcctgtgcagcctntggattcaccttcgataatggaatatgcagtgggtccncaggctccgaggcggaggggctggagtggggtggcagggtgtgtctatttcagttgggaaggtaaatacgaagttcgtaacgggtgtaacgtttcccgggttaggacggggtccctattcccaacccgtattacccgtacccgaaggtaacggaacctaaacgtttacccggaaacggaaaccaccgtaaggttcgttaccttaccgtttaacaaagttacgaaacgtacgcccgtagaacgaccctcgaacgggtaccgtaaccgggtcccggttaagtttaacgttttttggtacggttaccgtaagtaaccttacgttccgtttacgtttaaaccctaaaagtttcccgggtttactacgtttaccggtaaccggttccggttaacccggggg

SEQ ID NO: 424669 - DNA, 593 bp, Homo sapiens
  misc_feature: GZ8MTXP01DO728.44.27.C05.1.454.CMB.2.raw
  modified_base (160)..(160): a, c, t, g, unknown or other
  modified_base (288)..(288): a, c, t, g, unknown or other
  modified_base (459)..(459): a, c, t, g, unknown or other
  modified_base (528)..(528): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttccncgttgccctcttaagaggtgtcatgtgtcaggtgcaattcgtggagtcgtgggggagcgtggccccaggtagggggtccctgagactctcctgtgcagcctctggattcaccttgataattggaatangcagtcggccgccaggctccgaggcgaggggctgggagtggggtgcgaggttgtgtctatttcagtggagaaatcgaaaagtctaacggtgtaacgttcccggttagacggggtcccgattccaccctatccgtaccgagtacgaactaaacttaccgaagaacacagttntactcttacaaacttgaaacctgacctaggacacctacgacggacgacggtccgttgttaagttttggngtacgagtacgtacttcgttcgttactaagttcgtaactacgtacgaccggtccggttcgggccg

SEQ ID NO: 424670 - DNA, 667 bp, Homo sapiens
  misc_feature: GZ8MTXP01D73TL.44.27.C05.1.454.CMB.2.raw
  modified_base (266)..(266): a, c, t, g, unknown or other
  modified_base (307)..(307): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctcnggacttcaccttgataattggaatagtgcaggtcgggtccnccaggcctccgagggcgagggggctgggaggtggggtggcgtaggtgtgtctagtttccagtagggaaggaaatcgaaaaagttctaaggggttgtaacgtttcccgggttagggaacggggtcccgatttaccctacctacttctacccagaacgaactaaacgttccgaacgaaacacgtagtcttactacttacaaattacgaactacgcctacgacgacccgtacacgggaccgtacggtccggtgtttaacgttttgcgtcgttacgtaacttaacttcgtttacgtttaaccgtaaaatttccggttaacgtaacgtttccggaccgttccggttaaccgggggtaaccccggg

SEQ ID NO: 424671 - DNA, 647 bp, Homo sapiens
  misc_feature: GZ8MTXP01A5L0I.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctggattcaccttcgataattggaatatgcaggtcgggtccgccaggcctccgaggccggagggggctgggaggtggggtggcgaggtgtgtcatttccgagtgggaaggtaaatcgaaaagttcgtaacgggtgtactttcccggttggacgggtccgtattccacccactacctccgagacgaactaacgttaccgaagaaacacgtacgtgttaccttacttacgaaactacgaaacctacggacctagacgaccctacgacggaccgaaccgggtccgttgtttaagtttttgttggtcgttagtactacgttacgttcggtttacctaaaacgttcggttaactacgttccgaccggtccggttcggggtaacccgg

SEQ ID NO: 424672 - DNA, 747 bp, Homo sapiens
  misc_feature: GZ8MTXP01CYALC.44.27.C05.1.454.CMB.2.raw
  modified_base (269)..(269): a, c, t, g, unknown or other
  modified_base (294)..(294): a, c, t, g, unknown or other
  modified_base (305)..(305): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacggggggtccctgacgactctcctgtgcagcctntggattcaccttgataatggaatangcagtggtccncaggctcgaggcgagggctgggagtgggtggcgagggtgtgtctatttccgagttagggagtaaaatcgaaaaggttcgtaacgggtgtaagtttcccgggttaggacgggggtccctaattacccgaccctacgttcctacccgaagaacgtaaaccgtaaacgtttacccggaaagtaaaccgaggtaaagttcggttaccttacctttaacgtaaaaacgttacggaaaaccgtacggtacccctaaggaaccgtaacccgttaaccgaacgggtaaccgtaacccgggtcccgttaggttttaacgtttttggttacgggtacggacggttaaaccttacgtttaccgtttacgttttaaaccctaaaaacggtttccgggtttaacctacggttcccggttaacccggtccccgggttaacgggggtaacccccggg

SEQ ID NO: 424673 - DNA, 727 bp, Homo sapiens
  misc_feature: GZ8MTXP01DFXGI.44.27.C05.1.454.CMB.2.raw
  modified_base (225)..(225): a, c, t, g, unknown or other
  modified_base (236)..(236): a, c, t, g, unknown or other
  modified_base (269)..(269): a, c, t, g, unknown or other
  modified_base (519)..(519): a, c, t, g, unknown or other
tcagacagtatatacacgaccggtgctcgatttagacgcgatcgaaggggtttggggggggtcacaagaggcagcgctctcgggacgtctccaccatgacctgggctctgctgctcctcactctcctcacccaggacacagggtcctgggcccagtctgccctgactcagcctgcctccgtgtctgggtcgcctggacagtcggtcaccatctcctgcactgganccagcgtaatnttcttagtcttaactttgtctctgtatcaactntcatccaaggtaaacaccccaaactcaatcatctatgagacctaatagacgcccttgagggtttctaatcgcttcacctcgacctaccgaacgtcccggaaccaaccgtaaccggccccttacccgtacgtaaactaactccgttcggttacggggccctaccgacgggcgtaggaacgggaaccggaggtcttaggtattttaattagtttgtacgtaccttacggtagtagtttcgttaccggttacncctattccccttaaaagtttacgttcggtttaccgggttaccgggtaaaaggggttccggggttaaaacccgaaacgggggtttccccttaaaccccggggtttaccgtaaccgggggttacccacccggggaaccccgtaaaccgggtaccccccaaaaccccgtccgttccggttaccctaaccgtttccccgtttaacccccggg

SEQ ID NO: 424674 - DNA, 679 bp, Homo sapiens
  misc_feature: GZ8MTXP01CMGK4.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcaggtggtccncaggctccgaggcgaggggctgggagtgggtggcgaggtgtgtcatttccgagtggaggtaaatcgaaaagttctaacgggtgtagtttccggttaggacgggtcccgtattcccgacctactcctaccaagaacgaactaaacgttaccgaacgtaaaccaacgtacgttacgttaccttacctttactaaaacttacggtaaaccacggtaccctaggaaccgtaacccgtacgaacggaccgtaccgggtccgttggtttaacgtttttggttcggtaccggaaggtaacttacgttaccgttcgtttaacccgtaaaagttccgggtttaacctacgtttccggaccggtcccggttcgggggtaaccccgg

SEQ ID NO: 424675 - DNA, 761 bp, Homo sapiens
  misc_feature: GZ8MTXP01B0R23.44.27.C05.1.454.CMB.2.raw
  modified_base (673)..(673): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattaggaatatgcgaggtgggtccgccaggctccgaggcggaggggcgtgggaggtggggtggcgaggtgtgtctatttcagtggaaggaaatacgaagtcgtacggtgtacgttcccggttggacgggtccgtacttaccacccaattcctaccgaggaacgacctaaacgttaccccgaagaaacccacgtagttcgttcttaacttacaaataccggaacacgcccgtagacggaaccctacgaacggaccgaccgggtaccttgtttacttttggtgacgtagtaccgttattcgttacgtttaaccgaaaagtttccggtttctaacgttccggaccgtacccgggtacggggtaccgaaccgggtacccgtcgggttcccgtaacccgttcccgtcccgttcccgcccctacccgaacccggaaccgggtccccgtacgttccccggttccccgttaacccccgtcgggttccccncccccgttggaccccgttccgacgggttcccgaccccgttaacccgcggaacgaccgccgaccgaaccgggttcccgggtaacccggg

SEQ ID NO: 424676 - DNA, 595 bp, Homo sapiens
  misc_feature: GZ8MTXP01AWPOM.44.27.C05.1.454.CMB.2.raw
  modified_base (325)..(325): a, c, t, g, unknown or other
  modified_base (498)..(498): a, c, t, g, unknown or other
  modified_base (566)..(566): a, c, t, g, unknown or other
  modified_base (594)..(594): a, c, t, g, unknown or other
tcagacagtatatacacgaccggtgctcgatttagacgcgatcgaagggtttgggggaggcgtggccccagtagggggggtccctgagactctcctgtgcagcctctggattcaccttcgataattggaatatgcagtgggtccgccaggctccaggcgagggctggagtgggtggcaggtgtgtcatttcatggaggaaatcaagtctacggtgattccgttgagggccgattcaccatctcagagacaattccgagaacacagtgtctcttcaaaatgaaacagccctgacgacctcgaggaccacggccgtgttatttttgngacgagactatctgtttaccaaaattcggttcatttccgacgcgtggggccacgggaaaccctggtccaccgtctcccgtcggcctccaccgaacggcccagtcggtccttccccgtggcccgccctgcctccgaggacgccaccgtccgaggacgccacgacgccggcccgnggggcctcgccgtggtacaacgggtacctaaccgttccttaatacttacgtgtccttggcggccgggntcggcgaaggggtcccagtaacgttggng

SEQ ID NO: 424677 - DNA, 726 bp, Homo sapiens
  misc_feature: GZ8MTXP01CC9AR.44.27.C05.1.454.CMB.2.raw
  modified_base (308)..(308): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacggggggtccctgagactctcctgtgcagcctctggacttcaccttcgataattggaatatgcaggtcgggtccncgaggcctccgaggcgagggggctgggaggtggggtggcgtaggttgtgtctagtttcaggtaggaagtaactcgaaagttcgtaaggtgtacgtttcgttagggacggtccgtatccactactccgtacgagacgaacgtaacgttaccgaagtaaccacgagttacgtacttaccgttaacgaaaacgttacggaaacctacggtaccgtacggaacccgtacccgtacggaacgggtacccggtaccgggttcccgtttaggttttaacgtttttcggaccgggtacggttaacttaaccgtttacgtttaccgtttaccggttttaaacccgtaaaacggttttcccgggtttaacgttaaccggtttacccgggaacccggttcccggggttaacggggggtaacccccgggg

SEQ ID NO: 424678 - DNA, 621 bp, Homo sapiens
  misc_feature: GZ8MTXP01AT1GG.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (284)..(284): a, c, t, g, unknown or other
  modified_base (360)..(360): a, c, t, g, unknown or other
  modified_base (368)..(368): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaactttgtctcctggtatcaacatcatccaaggtaaacnccccaaactcatcatctatgagctaataagacgccctgtagggtttactaatcgcttcactcgctcagtcgacacncgcctccngacatctcgtcggctcaggctgaggacgaggctagattattattgtgctacgtagtagttgttaccgtgtcctatacttaactttagttcggttaccgtttacgggaacggttaacggggtaaccgttaaacgggttacccgttaacccggttcccgtaacggttccgaaccggttaacccccgaaacgggtaacccccaaacccccgttaaccgttccggttacccttaacccgttcccgttttcccccggg

SEQ ID NO: 424679 - DNA, 609 bp, Homo sapiens
  misc_feature: GZ8MTXP01EMFJ3.44.27.C05.1.454.CMB.2.raw
  modified_base (267)..(267): a, c, t, g, unknown or other
  modified_base (286)..(286): a, c, t, g, unknown or other
  modified_base (296)..(296): a, c, t, g, unknown or other
  modified_base (323)..(323): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntgatcactcgatatgatangcagtggtcncagctcgaggcgagggctggagtgggnggctaggtgtgtctatttcgagtgggaagtaatacgaagtcgtacgggtgtagttcccggttaggacggggcctagttccactatactccgagacgtaactaacgttaccgaacgaaacaactacgttacgttcttacgttaacaaattacgaaacgacgccgtagaacgtacctaccgtaggaccgtacggtccgtgtttacgttttgtgttacgaacgtacttagttcttacgtttaacctaaaatcggtttactacgttccggaaccgttccggtaaccgggg

SEQ ID NO: 424680 - DNA, 608 bp, Homo sapiens
  misc_feature: GZ8MTXP01EGGAU.44.27.C05.1.454.CMB.2.raw
  modified_base (380)..(380): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcaggtcggtccgcaggctccgaggcaaggggccgaggtggttggctagttatagcacagtcgataggaagttctagtaaaattattaagngacacgtacgtcggtaggaacggcctatcaactatctacgaagaacgactaacgtaccgaatagttgtagttacgttaggggaaacgttggtacacgcgtaggagtaggtacggacgtacctcggtctgttaagttagttacgtagttgacgtaaggttacggttcgggggttaggttaagggttaggtttaacggtttaccggtaccggggctaacgttaaggtcgg

SEQ ID NO: 424681 - DNA, 693 bp, Homo sapiens
  misc_feature: GZ8MTXP01CWPCD.44.27.C05.1.454.CMB.2.raw
  modified_base (281)..(281): a, c, t, g, unknown or other
  modified_base (325)..(325): a, c, t, g, unknown or other
  modified_base (330)..(330): a, c, t, g, unknown or other
  modified_base (339)..(339): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtgggtccgcaggctccaggcgagggctggagtgggtggcagggtgtgtcatttcagtggagaatcaagtcacggtnattcgtgaggcattcacatctacagacgacaatccgaagaacanagttntctacttanaaatcgaaacagcctagacgaacctacgaagggaccacgggtcccgtttagttacgtttttggacgacgtagtaacttattcgttacgtttaaccgtaaaagttccggtttactacgtttaccggaccggtcccgggtacggggtacccgtaaccggggtaaccccggttcgggtacccgtacccgttcccgttcccgtacccggtcccttacccgaaacccggaccgggtacccctacgttcccggttccccttaacccccggtcggcccggtccccttacgggtccctccgaaccggggttcaccgtaacccgtacccggaagaccgccgaacgtccgggcccgggtcccgg

SEQ ID NO: 424682 - DNA, 584 bp, Homo sapiens
  misc_feature: GZ8MTXP01B35S1.44.27.C05.1.454.CMB.2.raw
  modified_base (189)..(189): a, c, t, g, unknown or other
  modified_base (223)..(223): a, c, t, g, unknown or other
  modified_base (374)..(374): a, c, t, g, unknown or other
  modified_base (430)..(430): a, c, t, g, unknown or other
  modified_base (438)..(438): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaatttgtctcctggtatcaacatcatccaaggtaaacgacccccaaactcatcatctatgagtacctaataagacggtccctcgtaggggtttactaatcgtcttcacctcgctcaagtccgaacaacncgcctcctgacatctctgggctcgaggctgaggacgaggctagtattattattgtnctcgagtnttgttcgtcgctactctactttatcgttacgttcgggaaagttcggggaaccttaagggtccttaaccgtaccgtaggttacccgacgaccccgtaaacggcccctaaaccccgtacgtcgttacctaaccttccgtttaaccccg

SEQ ID NO: 424683 - DNA, 640 bp, Homo sapiens
  misc_feature: GZ8MTXP01BTH3C.44.27.C05.1.454.CMB.2.raw
  modified_base (562)..(562): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtggggggaggcgtcgggccccgagggttacggggggtccctgagactctcctgtgcagccctctggattcaccttgataattggaatagtgctaggtcgggtccgccaggcctccgagggcggagggggtctggggaggtgggggtggcgtagggttgtgttctagttttccgagtagggaaggtaaatcgaaaaggttccgtaaggtgtacgttccggtggacggggtcctattccaccatcctcgagacgactaacgttaccgaacgaacacgagtcgtacttactacaaagtacgaacagaccgtgacgaccctacgacggaccgtacggtccgttgttaagttttggngtcgttagtacgtacttcgttcgtttaacctaagttccggttctacgttccggttaccgtccggttcggggaacccgg

SEQ ID NO: 424684 - DNA, 676 bp, Homo sapiens
  misc_feature: GZ8MTXP01BBSQZ.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacgggggtccctgagactctcctgtgcagcctctggacttcaccttcgataattggaatatgcagtcgggtccgcaggctccgaggcgaggggctgggagtggggtggcgaggtgtgtctagtttccagttaggaaggtaaatcaaaacggttcgtaacgggtgtagtttacccgggttaggacgggggtcccgtaattcccgaacctactcctacccgagtaacgaacctaaacgtttaccgaacgtaacaacgtacgtcgttaccgttacctttaacaaacgttagaaacgtacgaccgttacgacgtacctaccgacggtaccgaacggttcccggtagttaagtttttcgttagtacgttaagtaacttacgttacgttacggtttacctaaaacgttcggttaactacgttacgaccgtccgttaacgggggtaaccccg

SEQ ID NO: 424685 - DNA, 607 bp, Homo sapiens
  misc_feature: GZ8MTXP01B24XH.44.27.C05.1.454.CMB.2.raw
  modified_base (291)..(291): a, c, t, g, unknown or other
  modified_base (304)..(304): a, c, t, g, unknown or other
  modified_base (328)..(328): a, c, t, g, unknown or other
  modified_base (338)..(338): a, c, t, g, unknown or other
  modified_base (351)..(351): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtggttttccgtcgttaggccctcttaagaggtgtcatgtgtcaggtgcaattcgtggagtcgtgggggaggcgtggccccaggtaggggggtccctgagactctctgtgcagcctctggacttcacttcgataatggaatntgcgagtggtccncaggctccgaggcgtagggctggnggtgggtggngtggtgtgtcgtnttcgtagtaggagtaagtacgtaagtacgtcgtgtacgttcgtggtacggtcgtactactacctactctacgacgacgtactaacgtacgacgaacgactacgtacgtactacttacgtaacgtacgacacgtacgtacgacgacgtacgacgtacgtacgtcgttgttgtttgttgtacgttacgtacgtacttacgttacgttacgtaacgttacgttaacgtcgtccgttaccggtccggttcgggtaaccgg

SEQ ID NO: 424686 - DNA, 624 bp, Homo sapiens
  misc_feature: GZ8MTXP01BG7K3.44.27.C05.1.454.CMB.2.raw
  modified_base (269)..(269): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtgggccccaggtagggggtcccctgagactctcctgtgcagcctntggattcaccttcgataatggaatatgcaggtgggtccgccgaggcctccgagggcggagggggcgtgggaggtgggggtggctagggtgtgtctagtttcagtgggaagaaatcaagtctacgggtgattccggttggacggggcctattccaccactacgtccaagacgaacaacgttaccgaacgaacaccagtcgtactacgttactaaatacgaaacagtccgtacgacgaccctacgacggacgaccgggtccgtgttagtttttggtcgttcggtaagtacttacgttcttacggtttaaccctaaagttccggttactacgttccgtaaccggttccggtccggggg

SEQ ID NO: 424687 - DNA, 631 bp, Homo sapiens
  misc_feature: GZ8MTXP01AUTNQ.44.27.C05.1.454.CMB.2.raw
  modified_base (388)..(388): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggacttcaccttcgaataattggaatatgcgaggtggtccgccaggcctccgaggcggaggggctgggagtgggtgcgaggtgtgtcatttccagtggaagaaatcgaaaagttctaacgggtnacgttccgttggacggggtcctattccacctactcctaccgagtaacgacctaaacgttacccgaagaaccaacgtacgttcgtacttacttacaaatcgaaacacgtcctagacgaccgtaccgacggaccgaccggtccgttgttaagttttggttcgtcggacgtacttacttcgttcggtttacctaaaacgttcggttaactacgttccgttaccggtccgttcggggtaaccccggg

SEQ ID NO: 424688 - DNA, 634 bp, Homo sapiens
  misc_feature: GZ8MTXP01EYABC.44.27.C05.1.454.CMB.2.raw
  modified_base (244)..(244): a, c, t, g, unknown or other
  modified_base (325)..(325): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgggtccagcaatgacagttggganatataacctgtctctggatcaacaacatccaggacaaacgcccccaaactcattacttttgagtccagtgagcggtccgtnaggttgttctaatccgactttctcgtggcctaccaagtctggcccacgaccggtcccttccctgtcgacttctcgtcgggccttccgggccttcggacgggtacgaggggtctacgaacttagttacgtgggtaccggtctacctaatttaccaaaccttcgtttagacggttaacgtttcgggggttcggtttaccggggcggggtaacggggtaccttccgacccgttaggtaccccgttaccggttacgggttcacccggcccgaaggcccgtccggcccccgttcggtccgttaacctttccccg

SEQ ID NO: 424689 - DNA, 665 bp, Homo sapiens
  misc_feature: GZ8MTXP01DJQX4.44.27.C05.1.454.CMB.2.raw
  modified_base (188)..(188): a, c, t, g, unknown or other
  modified_base (413)..(413): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctggtcnccgtggacagtcgtccacatcctctgcactggagcagtcgttaattattcttagttcttaacttcgtctcctaggtatcaaacatcactaccaaacggtaaacaccccaaactcatcatctatgacgctaagtacgacgccgtcgtagggttctaatcgtctcactcgctacgacgtccgaacacgcgtctcctagactatcgtgtcgctcgaggctaggacggngaggtacttagtatttattacgttgttgacttacggtagttaacttcggttacgtacgtctaacgtttacttaacgtttacgttacgttaaccggttacggggaaacggtaacgggggttaacccttaaaacggggttcccgttaaacccgttaccgtaaacggggttaccccaaacgggcccccgtaaaacccgggcccctaaaccccgtacttaccggttaccccttaacccgtttccctttaacccccg

SEQ ID NO: 424690 - DNA, 682 bp, Homo sapiens
  misc_feature: GZ8MTXP01AP46E.44.27.C05.1.454.CMB.2.raw
  modified_base (313)..(313): a, c, t, g, unknown or other
  modified_base (414)..(414): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacggggggtccctgacgactctcctgtgcaggcctcgtggtattccacttgataattggaatatgactaggtcgggtcccncgaggcctccgagggcggagggggtcgtggggaggtggggtggcgtaggttgtcgtactagtttccgagttggaaggtaaatcgaaaagttcgtaacggtntacgtttcggtggaacggggtcctagttccacctatccgtaccaggacaactaacgttaccggaacgtaaacaccgtaagtcgttacttacttaacaaacttacggaaccacgtccgtaggaacgtaccctacgaacggtaaccgtaccggtccgtttagttaagttttcgttacgtacgttaacgtacttacttacgtttacgtttaaccctaaaagttccggttaactaccggttaccgaccggtcccggttcggggtaaccccgg

SEQ ID NO: 424691 - DNA, 568 bp, Homo sapiens
  misc_feature: GZ8MTXP01DI07V.44.27.C05.1.454.CMB.2.raw
  modified_base (303)..(303): a, c, t, g, unknown or other
  modified_base (331)..(331): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcacttcgataatggaatatgcagtggtccncaggctcgaggcgagggctggagtgggnggcaggtgtgtctatttcagtggaagaatcaaagtctacgggtgtacttccggtgagggtccgattcactatctccagagactaacgttaccgaagaacacagtagtaccttacttactaaatacgaacacgcctgacgacctcgacgtacacggcgttgttatttgtgcgtagtacttacgttcttacgtttaacctaaaagttcgttctacgttcgtaacgttccggtaacgggg

SEQ ID NO: 424692 - DNA, 579 bp, Homo sapiens
  misc_feature: GZ8MTXP01ATERF.44.27.C05.1.454.CMB.2.raw
  modified_base (304)..(304): a, c, t, g, unknown or other
  modified_base (402)..(402): a, c, t, g, unknown or other
  modified_base (443)..(443): a, c, t, g, unknown or other
  modified_base (455)..(455): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcacttcgataattggaatatgcagtggtccnccaggctcgaggcgaggggctggagtgggtgcaggtgtgtcagtttcagtggaaggaatcgaagtctacgggtgacttcgtagacgggcctattcacntctccagagacacttccgagaacacagtcgttctacgttanaaactgaaacgngccgtgaacgaccgtcaaggaccgtaccgggtccgttaaggttaatttttggcgcgtacgtacttattccttaggtttaacccaaagttccggttactacgttccgaacgttccgtaacggggg

SEQ ID NO: 424693 - DNA, 586 bp, Homo sapiens
  misc_feature: GZ8MTXP01A4H0F.44.27.C05.1.454.CMB.2.raw
  modified_base (262)..(262): a, c, t, g, unknown or other
  modified_base (303)..(303): a, c, t, g, unknown or other
  modified_base (334)..(334): a, c, t, g, unknown or other
  modified_base (513)..(513): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcaccttcgataaattggaatatgcaggtgggtccnccaggctccgaggcgaggggctggagtgggnggcgaggtgtgtcatttccagtggaagaaatccgaaaagttctaacggtgtacttcccggttaggacgggtcccgatttccgacctaactctaccagacgactaacgttcgaagaacacagtcgtactactacaaatgaacacgctgacgctacgagacctacgcgtgttaacttttgngtcgacgtactacgttcttcggtttaccaaaagttccggttctacgttcgaccggtccgttcgggggaacccg

SEQ ID NO: 424694 - DNA, 642 bp, Homo sapiens
  misc_feature: GZ8MTXP01A2FQ3.44.27.C05.1.454.CMB.2.raw
  modified_base (264)..(264): a, c, t, g, unknown or other
  modified_base (300)..(300): a, c, t, g, unknown or other
  modified_base (405)..(405): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagctctctgtgcagcctntggattcactcgataatggaatatgcagtgggtccnccaggctcgaggcgagggctggagtgggtgcgaggtgtgtctatttcagtggaagtaatacgaagtcgtacgggtgtacttccgggtgacgggccgtatccgacntctaccgagtacgacaacttccgaacaacgacgagttgtactcttacaaagttcgaaactcgacccgttagacggtaccctcgtaacggaccgtacggtacccggttaagtttaggtttttacggacggttaccgtaaacggtacgttaaacgttccgtttaccggtttaacccgtaaaaacgttccgggtttaacctacggtttacccggtaaccgttccccgggttaaccggggg

SEQ ID NO: 424695 - DNA, 654 bp, Homo sapiens
  misc_feature: GZ8MTXP01BZV9D.44.27.C05.1.454.CMB.2.raw
  modified_base (262)..(262): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgtaattcgtggagtcgtgggggagcgtggccccgaggtacggggggtccctgagactctcctgtgcngcctctgattcaccttcgataatggaatatgcagtgggtccgccaggctccgaggcgaggggctgggagtggggtgcgaggtgttgtctatttcgagttgggaagtaaatcaaaggtctacgggtgtacttccggttagacgggccgtatcaccatctccagacacaattaccgaagaacacagtcgtctcttaccaaagttacgaaacgtacgaccgttagacgtacccgtacgaaggaccgtaacgggtcccgttagtttagtttttggtcgttacggtacgttactttaacgttcgtttcgttttaaacccttaaaaggtttccgggttacctaacggtttaccggaaccggttcccggttaacgggggaaccccgttaaacccggggg

SEQ ID NO: 424696 - DNA, 538 bp, Homo sapiens
  misc_feature: GZ8MTXP01ELDLX.44.27.C05.1.454.CMB.2.raw
  modified_base (224)..(224): a, c, t, g, unknown or other
  modified_base (236)..(236): a, c, t, g, unknown or other
  modified_base (315)..(315): a, c, t, g, unknown or other
  modified_base (368)..(368): a, c, t, g, unknown or other
  modified_base (384)..(384): a, c, t, g, unknown or other
  modified_base (396)..(396): a, c, t, g, unknown or other
  modified_base (435)..(435): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctcctggtatcaacatcatccaaggtaaacgcccccaaaactcatcatctatgagcctaanaagacgccctgagggtttctaatcgcttcacctcgctaccagtccgaacaacncgcctcctgacaatcnctggctcaggcngagacgaggctgattattattgtgctgagtattgttcgnctatctactttatgttccgttaggaaggtggaacaggtccacgttcgtaggttcgcgaccccgaaggccccaacccctatcgttactaaccgttcgttccccg

SEQ ID NO: 424697 - DNA, 725 bp, Homo sapiens
  misc_feature: GZ8MTXP01BNI69.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataattggaatatgcaggtgggtccgccaggctccgaggcgagggggctgggagtggggtggcgaggtgtgtcatttccagtgggaaggtaaatcgaaaaggtctaacgggtgtaacgtttcccgggtaggacggggtcccgtatttacccgaccctaagtccctaccgaaggacgaaccgtaaacgttacccgaaaggaaaccaacgtacgttacgttaccttactttacgaaaacttcggaaaaccacggacccgttaggaacgtaacccgtaccggaacgggtaacccgtaccgggtcccggttggtttaacgttttttcggttcggtaccggaacggttaaccttaacgttccgtttacggtttaacccgtaaaaacgtttccggggtttaacctaacggtttcccggttaacccgggtccccggttcgggggtaacccccggg

SEQ ID NO: 424698 - DNA, 614 bp, Homo sapiens
  misc_feature: GZ8MTXP01EV1ND.44.27.C05.1.454.CMB.2.raw
  modified_base (191)..(191): a, c, t, g, unknown or other
  modified_base (379)..(379): a, c, t, g, unknown or other
  modified_base (460)..(460): a, c, t, g, unknown or other
tcagacagtatatacacgaccggtgctcgatttagacgcgatcgaaggggtttggggggggtcacaagaggcagcgctctcgggacgtctccaccatggcctgggctctgctgctcctcactctcctcacccaggacacagggtcctgggcccagtctgccctgactcagcctgcctcgtgtcgtgggtcncctggacagtcggtcaccatcctcctgcagtggagccagtacgtaattattcttagttcttaactttgtctccgtgtatcaacatcatccaaggtaaaccgccccaaatcatcatctatgagctaataaggcgccctgtagggttactaatcgcttcacctcgacctacgaacgtcccggaacaaccnccggtccctccctagaactaactctcgtcgggctccgaaggtcgtaggaggacgaggtctagtattatacgtgacagctanagttataacgaagtaggaacttacgtttaactcgttcgggacgacgaagggaaccaaacgttcgtacgttacccgtacgttaacggaccgacggacccgtaacgggtccctcccggtcccccgtcggttaccctaaccgttcccgttcccccgg

SEQ ID NO: 424699 - DNA, 584 bp, Homo sapiens
  misc_feature: GZ8MTXP01D3GHO.44.27.C05.1.454.CMB.2.raw
  modified_base (301)..(301): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctcaggcgagggctggagtgggtggcgaggtgtgctatttccatggaggtaaatcgtaaaagtcgttaacgggtgagtttcccggttagacggggtccgattccacctatcctccgagagaacctaagttaccgaagaacacagtgtctacttacaaattgaaacagctgacacctcgacgtacacgggtaccgtggttaacttttaggcgtcgagtacctagttcttggtttacctaaaagttcggttaactcttcgaccgtcgttcggggtaacccg

SEQ ID NO: 424700 - DNA, 681 bp, Homo sapiens
  misc_feature: GZ8MTXP01ETGQQ.44.27.C05.1.454.CMB.2.raw
  modified_base (305)..(305): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacgggggtccctgagctctcctgtgcagcctctggattcaccttgataattggaatatgcaggtcggtccncgaggctccgagggcggaggggcgtgggaggtggggtggcgaggttgtgtctatttccgagtggaaggaaatcgtaaaagtcgtaacgggtgtacgtttccggttaggacggggtcctagttacccacctactcctaccaagacgaacctaaacgttaccgaacgaacacgtacgtcgttacttacttaacgtaaactacgaaaccacgtaccgtacgaacgtaccgtacgacggtaaccgtaccgggtccgttagtttaacgtttttggttcggtacgttaacgtaacttaacgttacgtttacgtttaaacccgtaaaagtttccggttaaccgttacgttccggaccgtcccgggttaacggggtaaccccgg

SEQ ID NO: 424701 - DNA, 696 bp, Homo sapiens
  misc_feature: GZ8MTXP01CYI91.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggattcaccttgataatggaatatgcaggtcggtccncaggctccgaggcgaggggctgggaggtgggtggcgtaggtgtgtctatttccgagtagggaggtaaatcgtaaaaagttcgtaacggtgtacgttcccgggttggacggggacctattcccgacctactccgtacccgaagaacgtaacaaacgtttaccgaagaaaccgacgtagtcgtacttacttaactaaacgttacgaaaccacgtacccgtacgtaacggaacctacgaacggtaccgtaaccgggtcccggtttaggtttaagtttttcggttacggtacgaacggttaacccttaagtttaccgtttacggtttaaccctaaaaagttccgtttaacgtacgttaccgggttaaccggtcccgggttaacgggggtaaccccggg

SEQ ID NO: 424702 - DNA, 639 bp, Homo sapiens
  misc_feature: GZ8MTXP01CNF0G.44.27.C05.1.454.CMB.2.raw
  modified_base (169)..(169): a, c, t, g, unknown or other
  modified_base (298)..(298): a, c, t, g, unknown or other
  modified_base (332)..(332): a, c, t, g, unknown or other
  modified_base (334)..(334): a, c, t, g, unknown or other
  modified_base (341)..(341): a, c, t, g, unknown or other
tcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggtttcctcgttgccctnttaagaggtgtcatgtgtcaggtgcaattcgtggagtctgggggagcgtggccccaggtagggggtccctgagactctcctgtgcaggcctctggattcaccttgataaatggaatatgcagtggtccncaggctccaggcgaggggcgtggagtgggtgggngngtgtgtntatctagtaggagaagtacgtaaagtacgtcgtgtagttcgtggacggacgtactactacctactactacacgagaacgtaaacgtaccgaacgaaacgaacgtagtacgtacttacttaacgtaaacgtaacgaacgaacgaccgtacgaacgaccgtaccgaacggtaccgaccggtaccggttaggtttaagtttggttacggtacggttacgtaacgttaacttacgttcgtttaaccgttaaacgttacgttaacgtacgttaccggttaccggtccggttccgggtaaccgg

SEQ ID NO: 424703 - DNA, 732 bp, Homo sapiens
  misc_feature: GZ8MTXP01BS02H.44.27.C05.1.454.CMB.2.raw
  modified_base (177)..(177): a, c, t, g, unknown or other
  modified_base (268)..(268): a, c, t, g, unknown or other
  modified_base (305)..(305): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagnggtgtcatgtgtcaggtgcaattcggtggagtcgtgggggaggcgtgggccccaggtagggggtccctgacgactctcctgtgcagcctcnggattcaccttgataatggaatatgcaggtcggtccncgaggctccgaggcggaggggctgggagtggggtggctaggttgtgtctatttccgagtaggaaggtaaatcgaaaagttcgtaacgggtgtaacgtttcccggtaggacgggtcccgtattccaccctagtacctccgaaggtacgaacgtaaacgttaccgaaacggtaaaccaaccgtagttacgttaccttacctttaacggtaaacgtttaacgaaaccgtaacggtacccgttacggaacgtaacccgttacgaaccggggtaaccgtaaccgggtcccggtttaggtttaacggtttttggttacggtacgttaacggttaaccttaacgttaccgtttacgttttaacccgtaaaacgtttcgggtttaacctacggttacccggttaccgggtaaccccggttcgggggtaaccccgg

SEQ ID NO: 424704 - DNA, 616 bp, Homo sapiens
  misc_feature: GZ8MTXP01DLZA0.44.27.C05.1.454.CMB.2.raw
  modified_base (189)..(189): a, c, t, g, unknown or other
  modified_base (223)..(223): a, c, t, g, unknown or other
  modified_base (284)..(284): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatattcttagtcttaactttgctcctggtatcaacatcatccaggtaaacnccccaaactcatcatctatgagcctaataagagccctgtaggggtttctaatcgcttcacctgcctcaagtcccggaacaacaaccggcctccctagacaactctcgtgggctcaggctgaggacgaggctgattattattgttgctacgagtagttcgttacgtcgtcctattctaactttatcgttacgtttaccgggaaaggttcggggaacccttaaaggggttcccaaacccgggttcccgttaaggggttaccaaccggacccccgtaaacgggacccccaaaccccctacgttccggttaccctaacccgttccgtttcccccgg

SEQ ID NO: 424705 - DNA, 584 bp, Homo sapiens
  misc_feature: GZ8MTXP01DUFRG.44.27.C05.1.454.CMB.2.raw
tcagacagtatatacacgaccggtgctcgatttagacgcgatcgaagggtttggggcctggggagacgagcccagcactggaagtcgccggtgtttccactcggtgatcatcactgaacacagaggactcaccatggagtttgggctgagctgggtttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtggtccgcaggctccaggcgaggggctgggagtgggtgcaggtgtgtcatttcagtggagaaatcaaagtctcggtgtagttccggttgacgggccgtattcacatctcagagacaattccgaagaacacagtgtactacttacaaatgaaacacggctagacgaccgtacgacggacgaccggtccgtgttaagttttgttagtacgttacgtacttacttacgttcgtttaacctaaaacgttcggttaactacgtaccggaccgtccgttcgggggtaaccccgg

SEQ ID NO: 424706 - DNA, 693 bp, Homo sapiens
  misc_feature: GZ8MTXP01CV4IN.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacggggggtccctgacgactctcctgtgcagcctctggattcaccttcgataattggaatatgcaggtcgggtccgccaggcctccgagggcggagggggctggggaggtgggggtggcgtagggtgtgtctagtttccagtggagaaatcgaaaagtctaacggtgtacgttccggtggacgggccgtatccgacctatcctaccgagaacgaactaacgttacccgaacgaaaccacgtagttcgttaccttaccttaacgtaaaattacgaaacctaacggtacccttacggaaccgacccgttaccggaaacgggtacccgtaaccggtccggttaggtttaacgtttttggttacggtacggttagtaaccgttacgttaccgtttacgtttaaccctaaaagttccggttaactacgtttacccggaccggtcccggttcgggggtaaccccgg

SEQ ID NO: 424707 - DNA, 672 bp, Homo sapiens
  misc_feature: GZ8MTXP01AQ6ZZ.44.27.C05.1.454.CMB.2.raw
  modified_base (284)..(284): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcagtcggccncaggctccgaggcgaggggctggaggtggggtggcagggtgtgtctagtttcagttgggaaggaaatcgaaagttcgtaacccggtgtagtttcccggtaggacggggtcccgtatttccgaccattcacccagacgacaaacttccgaagaacacagtgtctactacaaatcgaacagcctagacgaccgtacgaacggacgaaccgggtcccgttaggtttagtttttggtcgtacggtaacggtacttacttccgtttaagtttaaccgttaaaaacgttccgggtttactaaacgttccgggaacccggttcccggttacgggggtaacccgaacggggtaaccccgttacggggtcccacccggtccgttccccgtccccggg

SEQ ID NO: 424708 - DNA, 753 bp, Homo sapiens
  misc_feature: GZ8MTXP01BLRU2.44.27.C05.1.454.CMB.2.raw
  modified_base (225)..(225): a, c, t, g, unknown or other
  modified_base (236)..(236): a, c, t, g, unknown or other
  modified_base (313)..(313): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtccgcctggacagtcggtcaccatctcctgcactgganccagcgtaatnttcttagtcttaactttgtctctggtatcaacatcatccaaggtaaacgccccaaactcatcatctatgagactaanaagacgccctgtagggttctaagtcgcttcacctcgtcctaccgaacgtcccggaaccaaaccgccggtccctaccctagaccaacttccttccggtcgggcccttccgagggtcgtagggaacggggtacggtaacggggtccttaaggttaacttttaacgtttaagtttacggtttcgtaccgtttacgggtaggttaacgtttccgggtttaccggttccggtacctaaacgtttacccgtaaaccttttaagttcggttttaccgggttaaccggggttaaacgggggttaaccggggtaaaccggttaaaccggggttaccccgttaacccgggttacccgttaacggggttacccgaaccgaacccccggtaaaccgggacccccctaaaccccgtaccgtccggttaccctaaccgttcccgtttcccccgg

SEQ ID NO: 424709 - DNA, 591 bp, Homo sapiens
  misc_feature: GZ8MTXP01CRWGB.44.27.C05.1.454.CMB.2.raw
  modified_base (245)..(245): a, c, t, g, unknown or other
  modified_base (265)..(265): a, c, t, g, unknown or other
  modified_base (331)..(331): a, c, t, g, unknown or other
  modified_base (340)..(340): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggcccaggtacgggggtccngagactctctgtgcagcctntggacttcacttgatatgatatgcagtcggtccgccaggctccgaggcggaggggctggagtgggnggcagggtntgtctagtttcgagtggaagtaactcgaagttcgtagggtgaacgtttccggtggacgggtccatcacatctccagacgacaacttcgaagaacacagtcgtacttacttactaaatacgaaaccacgtaccgtagaacgaccgtacgacggaccgtaccggtccgttgtttagttttggtcgcgtaagtacttacgttcttacgttaactaagttcgttactacgttaccgtaacgttccggtaacgggg

SEQ ID NO: 424710 - DNA, 685 bp, Homo sapiens
  misc_feature: GZ8MTXP01CGJ7K.44.27.C05.1.454.CMB.2.raw
  modified_base (177)..(177): a, c, t, g, unknown or other
  modified_base (305)..(305): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagnggtgtcatgtgtcaggtgcaattcgtggagtcgtgggggagcgtggcccgaggtacgggggtccctgagactctcctgtgcagcctgtggattcaccttcgataattggaatatgcaggtcgggtccnccgaggcctccgagggcggagggggctgggaggtggggtggcgtaggtgtgtctatttccgagtagggaaggtaaatcgtaaaagttcgtaacgggtgtaacgtttcccgggttggacggggtaccgtattcccacctattaccgtaccagaacgaacctaaacgttacccgaagaaaccacgtacgttcgtacttacttaacaaattacgaacacgacctagacgacctacgacggaccgtaccggtccgttggtttaacgttttcggttacggtacgttaacgtaacgttactttaccgtttcggtttaaccctaaaacgtttccgtttaaccgtacgttaccggttaccggtcccggttaacgggggtaaccccggg

SEQ ID NO: 424711 - DNA, 637 bp, Homo sapiens
  misc_feature: GZ8MTXP01ED2O4.44.27.C05.1.454.CMB.2.raw
  modified_base (191)..(191): a, c, t, g, unknown or other
  modified_base (422)..(422): a, c, t, g, unknown or other
  modified_base (621)..(621): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacgagggtcctgggcccagtctgccctgactcagcctgcctcgtgtcgtgggtcncctggacaggtcggtcaccatctctgcacgtggacgccaaggtacggttaaattattttctttaagttctttaaacttttgtccttcctggtatctaaacatcataccaaggtaaaaccgacccccaaatcatcatctagagacgtctaaagtaaggacggtacccttacggtaagggtttactaagttccgtcttactacctcgtacctacgaacgtcccgaacaaaccnccggccctacccgtagacctaattccgtacgtcgggcctccgacggtcgacgggaacggacgaagggtcctaggtaatttagttagttctagtctagtagtcgttagtcgtcgcattctaatttgtgtacgttggaagtgggaacttagggtcccttaacgtcgtacgttcgaccgttacccgaacgaccctaaccctntcacgtccttcgtccc

SEQ ID NO: 424712 - DNA, 634 bp, Homo sapiens
  misc_feature: GZ8MTXP01B895I.44.27.C05.1.454.CMB.2.raw
  modified_base (287)..(287): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccaggtaggggggtcccctgagactctcctgtgcagcctctgattcaccttgattaattggaatatgcaggtggccncaggctccgaggcgaggggctggagtggggtgcgaggtgtgtctagtttcgagtggaaggaaatcaaagtctacggtgatttccgtgagggccctattccactatctcagacgactaatccgaagaacacagtgtctactacaaatgaactacgctagacgaccgtcgaaggaacctacgggtccgttgttaagttttggacgtcgtaacgtacttacgttcgttaacgtttaaccttaaaagttccggttactaaacgtttccgaaccggttcccggttacgggggtcccgtaaacgggtaaccccgtgggttccccgacccgttcccgttaacccgtcccccggg

SEQ ID NO: 424713 - DNA, 641 bp, Homo sapiens
  misc_feature: GZ8MTXP01AT24H.44.27.C05.1.454.CMB.2.raw
  modified_base (307)..(307): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctggattcaccttcgaataatggaatatgcagtgggtccnccaggcctccgaggcgaggggcgtgggaggtggggtggcgagggtgtgtcgtatttccagtggaggaaaatcgaaaaagtctaacggtgtacttcccgggttgacggggtcccgtaattcccaccctactactccagagaacaaacttacgaacgaaacacagtgtactacttacgaaattcgaaacacgacctacgaacgaccctacgaacggaccgaaccgggtccgttggttaacgttttggttaggcgttaaggtaacctaattcgttacgtttaccctaaaagttcggttaactacttaccggaccgtcccggttcgggggtaacccgg

SEQ ID NO: 424714 - DNA, 676 bp, Homo sapiens
  misc_feature: GZ8MTXP01CPFGW.44.27.C05.1.454.CMB.2.raw
  modified_base (190)..(190): a, c, t, g, unknown or other
  modified_base (222)..(222): a, c, t, g, unknown or other
  modified_base (666)..(666): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcatgganccagcgtaatattcttagtcttaactttgtctcctggtatcaacatcaatccaagtaaacgaccccctaaactcatcatctatgacgacctaataacgacgtccctagtagggtttactaagtcgtcttcacctcgcctacgaacgtcccggaacaaccgaaccggccctacccgtagaacctaacgtccttcgtacggggtccctccgaagggtccgtagggaacgggacggacggtacttaggtaatttagttagtttggttacgtacttacgggtaagttacgtttcggttaccgtaccggtacctaacttccgttaacctttagttcggttaccgtttacggggaaagggttaaccggggaaaccgttaaacgggtccgttacccggttacggtagggccttagttcgttaaccgacttaacggaaagtagttcgaacgngggtaagggg

SEQ ID NO: 424715 - DNA, 708 bp, Homo sapiens
  misc_feature: GZ8MTXP01EZ076.44.27.C05.1.454.CMB.2.raw
  modified_base (266)..(266): a, c, t, g, unknown or other
  modified_base (305)..(305): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacggggggtccctgagactctcctgtgcagcctntggattcaccttgataattggaatatgcaggtgggtccncgaggctccgagggcggagggggctgggaggtgggggtggcgagggttgtggtctagttttccgaagtaggggaaggtaaaatccgaaaaaaggttccgtaacgggttgtaacgtttcccgggttaggacgggggtccgtatttcccgaacctactccgtaccaaggaacgaactaaacgttacccgaacgtaaaccacgtagtcgttacttacttaacgaaaattacggaaacacgtaccgtagacgtaccctacgaacggaaccgtaccggtccggtttgtttaacgtttttggttacggtaccgttaaggtaaccttattaccgtttacgtttaacccgtaaaagttccgggttaactaacggtttccggaaccggtcccgggttccgggggaaccccgg

SEQ ID NO: 424716 - DNA, 644 bp, Homo sapiens
  misc_feature: GZ8MTXP01A9QJL.44.27.C05.1.454.CMB.2.raw
  modified_base (263)..(263): a, c, t, g, unknown or other
  modified_base (285)..(285): a, c, t, g, unknown or other
  modified_base (297)..(297): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctnggattcacttgataatggaatntgcagtggtccncaggcctccgaggcggaggggcgtggggtaggtcgggtggcgaggttgtgtctagtttccgagttcggaagtaaactcgaaagttcgtaacggtgtaacgtttccggtggacgggtccagttccaccgtatctaccgaagacgaactaaacgttaccggaacgaacaactagtacgtacttacttacgtaaacgttacggaaaccacggtaccgtagacgtaacccgtacggaaccggtaccgtaaccgggtccggttagttaacgttttggacgtacgagtacgttacttcgttcgtttaacgtaaacgttcggtaactacgtccgacgtccgttcgggaacccgg

SEQ ID NO: 424717 - DNA, 610 bp, Homo sapiens
  misc_feature: GZ8MTXP01C3HOC.44.27.C05.1.454.CMB.2.raw
  modified_base (189)..(189): a, c, t, g, unknown or other
  modified_base (224)..(224): a, c, t, g, unknown or other
  modified_base (237)..(237): a, c, t, g, unknown or other
  modified_base (306)..(306): a, c, t, g, unknown or other
  modified_base (459)..(459): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatcctctgcactggacnccagcggtaaatnttcttagtctttaactttgtctcctgtatcaacatcataccaggtaaacaccccaaactcatcatctangacgctaataacgacggtcccttcgtagggtttctaagtcgcttcacctcgacctccgaacgtcccggaaccaaccgccggtccctcccgtacgaactaactctcgtcgggactcgaggtcgtggagacgaggtctagtacttattattgttntctacgagtagttcgttacgtcgctattctacttgttcgttacgttacgggaagtcgggaaccgttaaggtcccttaccggtccgtaggttccgccgttacccgaaccggtacccaacccctagtccttacctccttcccgtttaaccccg

SEQ ID NO: 424718 - DNA, 629 bp, Homo sapiens
  misc_feature: GZ8MTXP01BV6PX.44.27.C05.1.454.CMB.2.raw
  modified_base (266)..(266): a, c, t, g, unknown or other
  modified_base (309)..(309): a, c, t, g, unknown or other
  modified_base (469)..(469): a, c, t, g, unknown or other
  modified_base (476)..(476): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcgtggagtcgtgggggagcgtggccccgaggtacgggggtccctgagactctcctgtgcagcctntggacttcaccttcgataattggaatatgcaggtcgggtcccnccaggcctccgagggcggagggggtctggggaggtgggggtggcgtagggttgttgtctagttttccaggttagggaagtaaatcgaaaagttcgtaacggtgtacgttccgggtgacgggcctattccgacctactcacagacgaactaacttaccganaaccganacgttcgtacttacttacgaaacgtacgaaccacgacctgaccgacctacgacggtaccgacggtccgttgttaagttttgttgcgttagtactattacgttcgttacctaaagttcgttaactagttccgacgtccggttcgggtaacccgg

SEQ ID NO: 424719 - DNA, 771 bp, Homo sapiens
  misc_feature: GZ8MTXP01EIUEA.44.27.C05.1.454.CMB.2.raw
  modified_base (172)..(172): a, c, t, g, unknown or other
  modified_base (270)..(270): a, c, t, g, unknown or other
  modified_base (312)..(312): a, c, t, g, unknown or other
  modified_base (420)..(420): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctnttaagaggtgtcatgtgtcaggtgcaattcggtggagtcgtgggggagcggtggccccgaggtacgggggtccctgacgactctctgtgcagcctcgnggtattccgaccttgataattggaatagtgcaggtcggtccnccgaggcctccgagggcggagggggctagggtaggtgggggtggcgaggttgtcggtactattttcccgagttagggaaggtaaacctcgaaaaggttctcgggggtntacgttttcccgggttagggaacggggtccgtaactttacaaccctaagtcccttaccgaaagaacgtaaacgtaaaaccgttaacccggaagaaaccaactacgggttacttaccttaaccttaaacgtaaaattacccggaaaacgtaccggaccgtaaccggaaccgtaccgtaaaccggacgggtaaccccgtacgggttaccgtttggtttaacggttttggttacggtaaccggttaacgttaactttaacgtttaccgtttaaccgtttaaaccgttaaacgtttccggttaaccgttacgttaccgggttaccgggtaacccgggttaaccgggtaacccggg

SEQ ID NO: 424720 - DNA, 535 bp, Homo sapiens
  misc_feature: GZ8MTXP01CW5Y8.44.27.C05.1.454.CMB.2.raw
  modified_base (335)..(335): a, c, t, g, unknown or other
  modified_base (462)..(462): a, c, t, g, unknown or other
  modified_base (514)..(514): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccgccaggctcgaggcgaggggctggagtgggnggcaggtgtgtctatttcagtggaaggaaatcgaagtctaggtgtatttccgtgacgggcattcacatctcagagacattaccgagaacacagtgtctctcaaatgaacagctgagacctcgagacncggcgtgttatttgtgcgtagcttagttcttagttaacctaaattcgttctnttacgtcgttccgtaaccggg

SEQ ID NO: 424721 - DNA, 617 bp, Homo sapiens
  misc_feature: GZ8MTXP01DMUL9.44.27.C05.1.454.CMB.2.raw
  modified_base (305)..(305): a, c, t, g, unknown or other
  modified_base (393)..(393): a, c, t, g, unknown or other
  modified_base (543)..(543): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggtttttcctcgttgccctcttaagaggtgtcatgtgtcaggtgcaattcgtggagtcgtgggggagcgtggccccaggtagggggtccctgagactctctgtgcagcctctggattcaccttcgaataagttggaatatgcagtcggtccncgaggctccgaggcgaggggctgggagtgggtggcaggttgtgtctatttccgagtgggaagaaatccgaaaaagttcgtaacgggtntaagttcccggttagacggggacccgtattccaccctatacctaccgaagaacgaactaaagttacccgaagaaacgacagtcgtcttacttaacaaatacggaaacacgtctagacgacctacgagacgacggtccgtgttaattttgngacgagtaactattacttcgtttaacctaaagttcggttctacgttccggaacgtccggttcgggggaacccgg

SEQ ID NO: 424722 - DNA, 677 bp, Homo sapiens
  misc_feature: GZ8MTXP01DOE95.44.27.C05.1.454.CMB.2.raw
  modified_base (214)..(214): a, c, t, g, unknown or other
  modified_base (339)..(339): a, c, t, g, unknown or other
  modified_base (342)..(342): a, c, t, g, unknown or other
  modified_base (346)..(346): a, c, t, g, unknown or other
  modified_base (359)..(359): a, c, t, g, unknown or other
  modified_base (407)..(407): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccaggtaggggggtccctgagactctcctgtgcagcctctggattcaccttgataattggaatatgcagtgggtccncaggctccgaggcgagggctgggagtgggtgcagggtgtgtcatttcagtggaaggaaatcgaagtctacggtgattccggtgacgggccattcaccatcctccagacacaatccgaagaacacngtntctntacaaatcgaacngcctgaacgaccctagaaggactacgggtccgttagttagtttttggngaccgtagtacttatcttacgttaacctaaaagttcggtttactagttccggaaccgtcccgtacggggacccgaaacggggtaccccgtcgggtacccgtacccgttccgtccccgtccggtcccctacccgaacccgaaccgggtcccctacgttccccggtcccttccccccggtgggttccccgtccccgttcgcccgtcccggagggcccaccccgtaacccgcccggaacgacggccgaacccgaacggttcccgggccccggg

SEQ ID NO: 424723 - DNA, 686 bp, Homo sapiens
  misc_feature: GZ8MTXP01A4NN7.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtgtccccccccccccccccccgagactctcctgtgcacgcctctggattcacccttcgataattggtaatatgcgagtgggtccgccgaggccgtccgaggcgaggggcgtggagtgggtggcgaggtgtgtctacgtttcagtaggaggaaagtacgaagtcgtacggtgtagttcgtgagggcgattcacctatctccagagaacaacttccgaagaacacagtacgttctacgtttacaaaacgttaggaaaccaaagtccgttacgaacggtaccctacgtaaccgggaccgaacccgggcccggtttaaggttaacgtttttttggtacgttacccggtaaggtaacccgtttattaccgttaccgttttaacccgtaaaaacgttccgggtttaacctaacgttccggtaacccgttccggtttaaccccgggggg

SEQ ID NO: 424724 - DNA, 587 bp, Homo sapiens
  misc_feature: GZ8MTXP01BLWPC.44.27.C05.1.454.CMB.2.raw
  modified_base (224)..(224): a, c, t, g, unknown or other
  modified_base (238)..(238): a, c, t, g, unknown or other
  modified_base (267)..(268): a, c, t, g, unknown or other
  modified_base (483)..(483): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggacnccagcgtaatattnttagtcttaactttgtctctgtatcaacnncataccagtaaaccgaccccaaactcatcatctatgacgtcctaataagacggtccctagtacggggtttctaactcgtcttacacctcggcctaccgaacgtcccggaacaaaccgccggtccctccctagactaactcgtcgtcggcctcgaggctaggacggagacggtcttgtaatttagttattgtcgtctgagtacgtttgtcgttacntactctattgtcgtacgtacggaagtcggtaacgttagtccgttaccgtacgtacgttcgccgacccgaaccgcccaacctcgtcgttacctccgttcgtcccg

SEQ ID NO: 424725 - DNA, 672 bp, Homo sapiens
  misc_feature: GZ8MTXP01CVNV3.44.27.C05.1.454.CMB.2.raw
  modified_base (189)..(189): a, c, t, g, unknown or other
  modified_base (222)..(222): a, c, t, g, unknown or other
  modified_base (264)..(264): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatctctgcactggacnccagcgtaatattcttagtcttaatttgtctctgtatcaacntcataccaacggtaaaccgaccccctaaactcatcatctatgacgactaataacgcgtcccgttacgtagggtttactaactcgtcttacacctccgacctccgaacgtcccgaaccaactccggccctccctagaacctatcctacgcgggtccctcgacggcgtaggacggacggaggtcgtagttatttagttcgtttagtcgtcctaggtagggtatttcggttacgcgtactagttaccttacttagttcgttacggttaccggaaagggttaacgggaaccgttaaacgggttccgaacccggttaccgtacggttacccggacccgttaaccccggaaacccggtaccccctaaccccgtaccgttacgttacccctaacccgtttcccgtttaacccccg

SEQ ID NO: 424726 - DNA, 573 bp, Homo sapiens
  misc_feature: GZ8MTXP01CEKJ5.44.27.C05.1.454.CMB.2.raw
  modified_base (265)..(265): a, c, t, g, unknown or other
  modified_base (314)..(314): a, c, t, g, unknown or other
  modified_base (379)..(379): a, c, t, g, unknown or other
  modified_base (425)..(425): a, c, t, g, unknown or other
  modified_base (503)..(503): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtgggccccaggtaggggggtccctgagactctcctgtgcagcctntggattcaccttcgataattggaatatgcagtgggtccgcaggctccgnggcggaggggctggaggtggggtggcgaggtgtgtctgtttccagtggagaatcaaagtctggtntagttccgttgacgggcgatcaccatctaccagagacaattccganaacacagtgtctcttacgaatgaacacgtcctagacgaccctcgacggaccgtacgggtcccgtgtttaacttttggngcgttagtacttattcgttcgtttaccaaattccggttcacgttcggaccgtccgttcgggtaaccccgg

SEQ ID NO: 424727 - DNA, 605 bp, Homo sapiens
  misc_feature: GZ8MTXP01CUEDZ.44.27.C05.1.454.CMB.2.raw
  modified_base (301)..(301): a, c, t, g, unknown or other
  modified_base (547)..(547): a, c, t, g, unknown or other
  modified_base (566)..(566): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataatggaatatgcagtcggtcnccaggctccgaggcgaggggctgggagtggggtgcgaggtgtgtcatttccgagttagggaggtaaatccgaaaagttcgtaacggtgtaacgtttcccgggttagacgggggccctattccgacctactctaccagaacgaactaacgttaccgaagaaacacgagtacgtaccttacttacaaacgttacgaaacacgaccgtagaacgtaccgtacgacgaccgaccggccgtgttaatttgngtacgagtactagttcttnttacaaattcggtctagttcgacgtccgttgggtaaccg

SEQ ID NO: 424728 - DNA, 786 bp, Homo sapiens
  misc_feature: GZ8MTXP01AV1PM.44.27.C05.1.454.CMB.2.raw
  modified_base (261)..(261): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggtttttcctcgttgccctcttaagaggtgtcatgtgtcaggtgcaattcgtggagtcgtgggggaggcgtggccccgaggtacgggggtccctgagactctctgtgcngcctctggacttcaccttcgataagttggaattatgcaggtcgggtcccgccaggcctccgagggcggaggggctggggagtgggggttgcgaggtgtgtctatttcgagtgggaagaaactcgaaaagttcgtaacggtgtacgtttccggttagggaccgggtctaagtttcccaacccgtacttacccgtacccgaaaggtaacgtaaacctaaacgtttaccccggaaagtaaacccgtaacgtaaacgtttcggttaccctttaacctttaacgaaaacgttcggtaaaacctacggtacccgttacggaaccgtaccccgttacgaacccgggaaaccggtacccgggtacccgggtttgttttaaaccggttttttcggaggtacccgttaaggtaaaccgtttaacttaccggttttaacgttttaaccccggttaaaaatttccccggggtttaacttaaccggtttacccggttaaccccgggtccccgggtttaaccgggggtaacccccgggg

SEQ ID NO: 424729 - DNA, 641 bp, Homo sapiens
  misc_feature: GZ8MTXP01EBZVG.44.27.C05.1.454.CMB.2.raw
  modified_base (269)..(269): a, c, t, g, unknown or other
  modified_base (287)..(287): a, c, t, g, unknown or other
  modified_base (289)..(289): a, c, t, g, unknown or other
  modified_base (291)..(291): a, c, t, g, unknown or other
  modified_base (297)..(297): a, c, t, g, unknown or other
  modified_base (311)..(311): a, c, t, g, unknown or other
  modified_base (326)..(326): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtcctgagactctcctgtgcagcctntgatcacttgatatgatntncngtgtcncaggctcgagcggngggctggagtggggngcgtaggtgtgtctatttacagtggaaaggtaaatacgaaagttcgtacggtgtaacgtttccggtaggacgggccgtattacaccatctacagaacgaactaacgttaccgaagaacaactagtacttactacttaactaaagttacgaaacacgtacgtacgtacgaaccctacgtaacggaccgtaccgggtccgttaagtttaacgtttttggtacggttaccgtaaggtaaccttagtttctttacggtttaacctaaaaacgttccggtttacgtaacttaccgggtaaccgttccggtaacccggggg

SEQ ID NO: 424730 - DNA, 684 bp, Homo sapiens
  misc_feature: GZ8MTXP01CKR7Q.44.27.C05.1.454.CMB.2.raw
  modified_base (272)..(272): a, c, t, g, unknown or other
  modified_base (283)..(283): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtaggggggtccctgagactctcctgtgcagcctctgattcaccttgataattgaatntgcagtggccncaggctcgaggcgagggctggagtggggtgcgaggtgtgtctatttcgagtgggaagtaaatcgaaagttcgtacccggtgtacgtttccggtggacggggtacctagttcccaaccgtatcctaccgaagacgaactaaacgttaccgaagaacacgagtacgttactacttacaaatacgaacacgacctagacgacccgtcgaacggacgtaccgggtccgttagttcgttttaggtacgtaccgtagtaccttacgttccgttaacggtttaacccttaaaacggtttccggttacgtaaacgttccggacccggttcccgggttaccgggggtaacccgtaaccggggtaaccccgtcgggtaccccgttacccggtcccgttccccggtccccgg

SEQ ID NO: 424731 - DNA, 620 bp, Homo sapiens
  misc_feature: GZ8MTXP01A2XBS.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcaggtcgggtccncgaggctccgaggcgagggggctgggagtgggtggcgaggtgtgtctatttccagtggaagaaatcgaaaagttctaacgggtgtaacgtttcccgttaggacggggcctattccacctatctaccagaagaactaaacgttaccgaagaaacaacagtcgtacttacttaacaaattggaaacacgacctagacgacctacgacgacgaaccggtccgttggttaattttcggagtcggttagtaaccttattcttcggtttaacctaaaagttcggttaactagttaccggacgtcccggttcggggtaacccgg

SEQ ID NO: 424732 - DNA, 554 bp, Homo sapiens
  misc_feature: GZ8MTXP01DNB1E.44.27.C05.1.454.CMB.2.raw
  modified_base (305)..(305): a, c, t, g, unknown or other
  modified_base (374)..(374): a, c, t, g, unknown or other
  modified_base (488)..(488): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtcgggtccncaggctcgaggcgaggggctgggagtgggtggcaggtgtgtcatttccatggagaatcaaagtctggtnagttcgtgagggcattcacatctcagacgacaattccgatacactagtgtactacttacaaatgaaacagcctagacgacctacgacggacgacggtccgttgtttaattttgngtcgagtactagttcttgtttacctaaaatcggttaactacgtcgacgtccgttcggggtaacccg

SEQ ID NO: 424733 - DNA, 677 bp, Homo sapiens
  misc_feature: GZ8MTXP01BTS3J.44.27.C05.1.454.CMB.2.raw
  modified_base (264)..(264): a, c, t, g, unknown or other
  modified_base (301)..(301): a, c, t, g, unknown or other
  modified_base (343)..(343): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgacgactctcctgtgcagcctntggattcaccttgataatggaatatgcagtgggtccncaggcctcgaggcgagggggctgggaggtgggtggcagggtntgctatttccgagtggaagaatcgaaaagtcgtaacggtgtaacgtttcccggttagggacgggtccgtattccaccgtactcctaccgaagtaacgaactaaacgttacccgaagaaaccgaaggtacgttacgtacgttcttaacgaaacttggaaacctacggtacctaggaacgaccgtacgaacgggtaccgtaacgggtcccgttaggtttaacgttttggttacggtcgttaagtaccgttaacgttaccgtttcggtttaacctaaaacgtttccgggttaactaacgtttaccgggaaccggtccggttccgggggtaacccggg

SEQ ID NO: 424734 - DNA, 663 bp, Homo sapiens
  misc_feature: GZ8MTXP01BHHI4.44.27.C05.1.454.CMB.2.raw
  modified_base (277)..(277): a, c, t, g, unknown or other
  modified_base (287)..(287): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctgtggattcacttnatatggaatntgcaggtggccgcaggctccgaggcggaggggctgggacggtggggtggcgtaggttgtgtctagtttccgaggtaggaaggtaaatcgaaaagttcgtaacgggtgtaacgtttcccggtaggacggggtccctagttaccacctactccgtaccgagaacgaacgtaaaccgttaccgaaagaaccaacgtagtacgttaccttaccttaacgtaaagttacgaaaccgtacgacccgtagaaccgtaccctaacggacggaaccgtaccgggttaccgttggtttaacgttttggacgtacgttacgtaactcgttccgtttacgttacttaaagtccgttaactacgtcgaccgtccggttcgggaacccgg

SEQ ID NO: 424735 - DNA, 683 bp, Homo sapiens
  misc_feature: GZ8MTXP01ETS96.44.27.C05.1.454.CMB.2.raw
  modified_base (311)..(311): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctcgtggacttcaccttcgataattggaatagtgcgaggtcgggtccnccgaggcctccgagggcggagggggcgtgggaggtggggtggcgtagggttgtgtcgtagtttccgaggtagggaagaaatccgaaagttccgttaagggttgtaagtttcccgggtaggtacggggtaccgtaaactttcccgaaccctagttacccgtaccgaaggtaacgaaccgttaaacgttcccgaaagaaccaccgtagtcgttactacttaacgaaattcgaaactacgccgtagacgtacctacgacgacgtacggtccgttagttaacgtttggcgtacgttacgtacttacttcgtttacgttaaccgtaaacgttccggttaactacgttaccggaccgtaaccggttcggggaaccccg

SEQ ID NO: 424736 - DNA, 675 bp, Homo sapiens
  misc_feature: GZ8MTXP01AXPQ3.44.27.C05.1.454.CMB.2.raw
  modified_base (270)..(270): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtacgggggtccctgagactctcctgtgcagtccctntggacttcaccttcgataagtggaatatgcaggtcggtcccgcgacggcctcgaggcggagggggctggggagtgggggtgctagggttgtcgtctactttcgagttacgggaaagtaaattcgaaacggttcgtacggggtgtacgtttccggttagggaacgggtcctatccgtaactactccgtacaacgaagaacctaaacgttaccgaagaacacgtaagttctacttacgtaactaaatacgaacgacgtcccgaggaactacccgcgtaacgggaccgtaacggtccggttaagttgtttttacggagttacgtaacgtaacttacgttccgttacgtttaaccgtaacgtttccggttacgtacgttaccggtaaccgggttcccgggtaaccgggg

SEQ ID NO: 424737 - DNA, 625 bp, Homo sapiens
  misc_feature: GZ8MTXP01AWPTC.44.27.C05.1.454.CMB.2.raw
  modified_base (214)..(214): a, c, t, g, unknown or other
  modified_base (380)..(380): a, c, t, g, unknown or other
  modified_base (409)..(409): a, c, t, g, unknown or other
  modified_base (549)..(549): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccagtaggggggtccctgagactctcctgtgcagcctctggattcaccttcgataattggaatatgcagtgggtccnccaggctccaggcgaggggctgggagtgggtggcaggtgtgtcatttcatggaggaaatcaagtctacggtgattccgtgagggccattcaccatcctccagtacgactaattccgaagaacactagtgtcttacttacaaaatcgaaacagccctgacaaccctnaacggacacgggtccgttgttattttggngcgtagtactattctagtttaccaaaagttcggttactagttccgacgccgtcggggccacgggacccgtggtcctaccgtcctccgtccggcctcccgaccgtacggccctacgtccggtcccttccccgcggttcccncccgttacgtcccgtacccgacgggttccaccctaaccccgtcgaacggcgaccgaccgaacggcccgggtcccgg

SEQ ID NO: 424738 - DNA, 725 bp, Homo sapiens
  misc_feature: GZ8MTXP01B2HT4.44.27.C05.1.454.CMB.2.raw
  modified_base (275)..(275): a, c, t, g, unknown or other
  modified_base (299)..(299): a, c, t, g, unknown or other
  modified_base (348)..(348): a, c, t, g, unknown or other
  modified_base (559)..(559): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgttgggttttcctcgttgccctcttaagaggtgtcatgtgtcaggtgcaagttcgtggagtcgtgggggaggcgtcggccccgaggtacgggggtccctggacgctcctcctgtgcagcctntggattcaccttgataatggaatntgcgaggtcggccgcgaggcctccgaggcggagggcgtggaggtggggnggcgtaggtgtgtactagttacgagtagggagtaaatacgaaagtcgttaacgggtgttacgttccggtaggacgggtacctagttaccaccgtactaccgtaccgaagacgtaaacgtacgttaaccgaacgaaaccacgtacgttacgttacccgttacgttaaacaaaacgttacgaaaccgacgtaccgttacgaaccgttaacccnccggaaacggtacccgtaaccgggttcccggttaagttttcgtttttacgggacgttaccgtaacggtaaccttacgtttaccgtttaccgttttaaacccgtaaaaggtttccccgggttactaaccgttaccgggtaaccccggttaaccgggtaacccggggg

SEQ ID NO: 424739 - DNA, 595 bp, Homo sapiens
  misc_feature: GZ8MTXP01B74DD.44.27.C05.1.454.CMB.2.raw
  modified_base (198)..(198): a, c, t, g, unknown or other
  modified_base (378)..(378): a, c, t, g, unknown or other
  modified_base (387)..(387): a, c, t, g, unknown or other
  modified_base (394)..(394): a, c, t, g, unknown or other
  modified_base (567)..(567): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacngtcgtcaccatcctcctgcacgtggagccaagtcgttaaattatttcttagttctttaactttgtcttcctggtatcaactatcataccaagtaaaccaccccaaactcatcatctatgacgtacctataagacgccctgtacgggtttctaatcgctcactcgctacgacgtcgacacnccgcctccngacatcncgcggctcgagcgtagacgagaggtctagtattacgttagttgttgtctggagttagttcgttacgtcgtctactacgttaacttagtccgttacgttacggaagttcgggaaccgttaggtcccgaccggttacgtacggttaccgacgttacccgaacgacccctaacccncgtcttacctaaccgttcgttaaccccg

SEQ ID NO: 424740 - DNA, 717 bp, Homo sapiens
  misc_feature: GZ8MTXP01A89XK.44.27.C05.1.454.CMB.2.raw
  modified_base (265)..(265): a, c, t, g, unknown or other
  modified_base (298)..(298): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtcctgacgactctcctgtgcagcctnggattcacttcgatatggatatgcagtggtccnccaggcctccgagggcggaggggctgggaggtgggtggcgaggtgtgtcatttccgagtggaacgaaatcgaaaagttcgtaacgggttgtaacgtttcccgggttaggacgggggtcccgtagttacccgaaaccctacgtacccttaccgaacggaacgtaaacctaaaacggtttacccgaaagaaaccgtaacgtacgtcgttaccgttaccttaaacctaaaagttcggaaaacctacgtacccgtacggtaaaccgtaacccgttaaccggaacggaacccgtaacccgggttccggtttaaggtttaagtttttcggttacgggtacgttacggtaacttacgttacgtttacgtttacccgtaaaagttcggttaactaacgttccggacgtccggttaacggggaacccg

SEQ ID NO: 424741 - DNA, 715 bp, Homo sapiens
  misc_feature: GZ8MTXP01BAF2G.44.27.C05.1.454.CMB.2.raw
  modified_base (155)..(155): a, c, t, g, unknown or other
  modified_base (288)..(288): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggaggcgtggccccgaggtacgggggtccctgagactctcctgtgcagcctctgattcaccttgataattggaatatgcaggtcgggccnccaggctcgaggcggaggggctgggagtggggtgcgtagggtgtgtctagtttcagtagggaggaaatcgaaagtcgtacggtgatttccggtagagggacctattccacatcctaccgaagacgtaactaacgttacccgaagaaccaacgtagttacgttaccttacttaacaaatacgaaaccgtacgtcccgtagaaccgtaccgtacgaacgggacccgtaaccgggttccgtttaggtttacgttttttagggtacgtacggtaacgtaaccttacgttccgtttaacggttttaaacccgttaaaacggtttccggttaccgtaacgtttccggttaaccggttccggttaccgggggaacccgtaacggggtaaccccgttcggtacccgttacccggttcccgttccccgtccccggg

SEQ ID NO: 424742 - DNA, 700 bp, Homo sapiens
  misc_feature: GZ8MTXP01DPNOM.44.27.C05.1.454.CMB.2.raw
  modified_base (302)..(302): a, c, t, g, unknown or other
  modified_base (331)..(331): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggagcgtggccccaggtagggggtccctgagactctcctgtgcagcctctggattcaccttcgataattggaatatgcagtggtccnccaggctcgaggcgagggctggagtgggngcgaggttgtgtcatttccagtaggaaggtaaatcgaaaagtctaacgggtgtaacgtttcccgggttggacggggtccgtaatttcccgaacccgtacttccgttacccgaaggtaacgtaaacccgtaaaacgtttaccccggaaagtaaacccaaacgtacgttcgttaccttacctttaacgaaaacgtttacgaaacaacggtcctaggaaccgacccgttacgaaacggtaccgtacgggtcccgttggtttaagtttttggacgggtccgttaaaggtaacttattaccgtttcgttttaaaccccgtaaagttccggtttaactaacgttaccggaccggtccggttcggggtaaccccgg

SEQ ID NO: 424743 - DNA, 731 bp, Homo sapiens
  misc_feature: GZ8MTXP01AXB8I.44.27.C05.1.454.CMB.2.raw
  modified_base (266)..(266): a, c, t, g, unknown or other
  modified_base (302)..(302): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcacttcgataatggaatatgcagtggtccncaggctcgaggcgagggctgggagtgggtggcaggtgtgtctattttcgagttggaaggtaaatcgtaaagttcgtacgggtgacgtttccggttaggacggggcctacttccgacctatccgtaccagaacgaaccgtaacgttacccgaagtaaaccacgaacgttacgtacttaccgttaactaaaacgttacgggtaaaccaacggtccctaacggaaccggtaaaccccgttaccgtaaaccggggacccggtaaaccggggttccccggtttaacggttttaaaggtttttttcgggtacggttacccgggtaaagggtaacgtttactttaccgtttaacgggttttaacccctaaaaaggtttcccgggtttaccgttaaccgtttacccgggtaaccggttccccgggttaacccggggg

SEQ ID NO: 424744 - DNA, 711 bp, Homo sapiens
  misc_feature: GZ8MTXP01BNXFD.44.27.C05.1.454.CMB.2.raw
  modified_base (306)..(306): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacgggggtccctggagactctcctgtcgcagcctcgtggattcaccttgataatggaatatgctggtcggtccncgaggctaccgaggcggagggctgggagtgggtgcgaggtgtgtctagtttccagtaggaagaatcgaaaacgttcgtaacggtgtaacgtttccggtaggacgggtccgtaattccgaacccgtatccgttacccgaagaacgtaactaaacgttacccgaacgtaaaccaccgtagttcgttacttaccgttaacgtaaaagttacgaaaccgtacgtacctacggaaccgtaccgtaacggacggtacccgaaccgggttcccgttaggtttaacgtttttcgggttacgtaccggttaaacgtaaccgtttacgttacccgtttacgtttaacccgtaaaacgtttcgggttaaccttaacggttcccggaccgtcccgggttaaccggggtaaccccggg

SEQ ID NO: 424745 - DNA, 627 bp, Homo sapiens
  misc_feature: GZ8MTXP01EIAFK.44.27.C05.1.454.CMB.2.raw
  modified_base (191)..(191): a, c, t, g, unknown or other
  modified_base (270)..(270): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctagacagtcggtcaccatctcctgcacgtggagccagcggtaaatattcttagtcttaacttgtctctgtatcaacntcataccaagtaaacgccccaaatcatcatctatgaggacctaagtaacggacgcccttagtagggtttctaacgtcgtcttcaaccgtcacctaccgaacgtcccgaaccaaaccgcccggccctacccagaacctaactcgtcgtcgggcctcggacggtcgtagaacgggacgtaagggtcttaggttaatttagttactttggttgtctacgtaaggtcgtttgttacgtcgacttactcttaactttagtcgttacgtaggaaggtaacggaaccgttaggccgttaccgtcgtaacggttcgaccgttacccgaacggccccaaccgtctacgttctaacttccgttcccg

SEQ ID NO: 424746 - DNA, 774 bp, Homo sapiens
  misc_feature: GZ8MTXP01AK9O0.44.27.C05.1.454.CMB.2.raw
  modified_base (311)..(311): a, c, t, g, unknown or other
  modified_base (484)..(484): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctccgtgtgcagtcctcgtggacttcaccttcgataattggaatatgcgaggtcgggtccnccgaggcctccgagggcggaggggcgtgggagtgggggtggcgtaggtgtgtctagtttccaggtggaagtaaactcgaaaaagttctaacgggtagtacgtttccggttaggacggggtccgtaatttcccgacctagtcctaccgaaggacgaactaaacgttcccggaanaacctacgtagttcgtaccttacttaacgaaagttaccgaaacgtacgtacccgttaaggacccgtaacccgttaccggaaacgggtacccgtaccggggttaccccggtttggtttttaaacgtttttcgggttacgggtaaccggttaaaccgggttacctttaaacgtttcccgttttacggttttaaaaccccgttaaaacggtttaccccggggttttaactaacccgggtttccccgggaacgggtttaacccccggggttaacggggggttaaacccccgggg

SEQ ID NO: 424747 - DNA, 651 bp, Homo sapiens
  misc_feature: GZ8MTXP01C7NU7.44.27.C05.1.454.CMB.2.raw
  modified_base (285)..(285): a, c, t, g, unknown or other
  modified_base (313)..(313): a, c, t, g, unknown or other
  modified_base (363)..(363): a, c, t, g, unknown or other
  modified_base (408)..(408): a, c, t, g, unknown or other
  modified_base (526)..(526): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttgataattggaatatgcagtggccncagctcgaggcgagggctggagtcgggnggcgaggtgtgtctagtttcagtgggaagaaatcgaaagttctaacggtnattccggtggaggacccgtattccaactatctaccaggaacgtanaaactacgaagaacacagtgtctacttacaaatacgaacgacgccgtagaacgaccgtacgacggtaaccaaccgggtcccgttagttaacgtttttggacgtccgtaaggtaccttntacgttaaccgtttaaccgttaaaacgtttcgggttaccttaacgttccggttaaccgccgttaccggggccgtaaccgggtaaaccctcgggtacccttaacccgtccgttaacccgtccccgg

SEQ ID NO: 424748 - DNA, 606 bp, Homo sapiens
  misc_feature: GZ8MTXP01AULFE.44.27.C05.1.454.CMB.2.raw
  modified_base (190)..(190): a, c, t, g, unknown or other
  modified_base (224)..(224): a, c, t, g, unknown or other
  modified_base (256)..(256): a, c, t, g, unknown or other
  modified_base (440)..(440): a, c, t, g, unknown or other
  modified_base (442)..(442): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaattattcttagttctttaactttntcctctggtatcaacatcatccaagtaaacgaccccaaactcatcatctatgagtacctaagtaagacgcccgtgtacgggtttctaatcgtcttcacctcgcctacaacgtccgaacaaccgccgtccctccctagactactctcgtcggctcgaggcgtgaggacgagctgtattattgttntnctagagtagttcgttcggctctatcttactttagtcgttacgttacgggaaggtcgggtaacccggttaaaggttccgaccgttaccggtacggttcccgacgttaacccccgaaggaccccctaacccgtaccgtcttaccgtaacccgtttccgttcccccg

SEQ ID NO: 424749 - DNA, 752 bp, Homo sapiens
  misc_feature: GZ8MTXP01B1IPW.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtcggcccgaggtacggggggtccctggagtactctccgtgtcgcagcctgtggtacttccgacttcgaataagttaggaatatgcgtaggtcgggtcccgccgaggccctaccggaggggcggagggggctagggggacggtgggggtcggcgtagggttggtcgtcgtacgtttaccgaggttagggaacgtaaatcggtaaaggttccgtaacggggttgtacgtttaccggggtacggacggggtaccccgtattaccctaaccgtactaccgttaccgagtaacgaacgtaaacgttaccgaaacgtaacacgtacgtacgttaccttaccgttaagtaaaacgtacggtaaacccacgtaacccgttacgtaacccgacccgttaaccgacgggtaacccgtaaccgggttccgttggtttaacgttttggacgtacgttacgtacttaagttaccgtttcgtttaaccgtaaacgttcggttaacttacggtccgttaccgggtcccggttaaggggtaaccccgg

SEQ ID NO: 424750 - DNA, 684 bp, Homo sapiens
  misc_feature: GZ8MTXP01EVAWY.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagtctgggttttcctcgttgccctcttaagaggtgtcatgtgtcaggtgcaattcggtggagtcgtgggggagcgtggccccgagggtacgggggtccctgagactctcctgtgcagtcctgtggacttcaccttgaataatggaatatgacgtaggtcgggtccaccgaggcctccggagggtaccggagggggtctgggggaggtcgggggtggcgtagggttgttcgtacttagtttccgagttagggaagtaaatcgtaaaagggttctaagggtgtacgtttccggtaggacgggtacctattacccgacctattaccgacgtagaacgtaacgtaaacgttaccgaacaaaccacgtacgttacgtaccttacttacaaatacgtaaaccacgtaccgtagaaccgtaccgtacggacgaccgtaccggtccgttagttcgttttggcgtacggatacttattaccgttcgtttaaccgtaaacgttccggtaactacgttcggttaccggtccggttcggggtaaccccgg

SEQ ID NO: 424751 - DNA, 636 bp, Homo sapiens
  misc_feature: GZ8MTXP01A859I.44.27.C05.1.454.CMB.2.raw
  modified_base (270)..(270): a, c, t, g, unknown or other
  modified_base (308)..(308): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagactctcctgtgcagcctntggattcacttcgataattggaatatgcagtcggtccncaggctccgaggcgaggggctggagtgggtgcaagtgtgtcatttcagtggaagaaatcaagtctaggtgagttccgttggacgggcctagttccacgatcctaccgagacgaacgtaacttaccgaacgtaaacaacgaagttcgtaccttaccgttaacaaaagttacgaaactacggtcccgtagtaaccgaacctcgaaccgggtacgaaccgggtcccgttgttacgttttgtcgacgtaagtacttaacgttcgtttaacgtttaacctaaaacgttccgggttacttacgttaccggtaacccggttccggtaaccggggg

SEQ ID NO: 424752 - DNA, 622 bp, Homo sapiens
  misc_feature: GZ8MTXP01AN0A9.44.27.C05.1.454.CMB.2.raw
  modified_base (316)..(316): a, c, t, g, unknown or other
  modified_base (455)..(455): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagttgggctgagctgggttttcctcgttgccctcttaagaggtgtcatgtgtcaggtgcaattcgtggagtcgtgggggaggcgtcggccccgagggtacgggggtccctggagtacctctcctgtcgcagcctcgtggacttcaccttcgataagttggaatatgctaggtcgggtccnccaggctccgagggcgaggggctgggagtggggtgcgaggttgtgtctagtttccgagtaggaagaaatcgaaaagtctaacgggtgtagtttcccggtggacgggtcatcactatcctacagacgactaacgtcgaanaacacgtagtcgtacttactaacgaaacgtagaacacgcctagacgtacctagacggtaccgtacggtccgttgttaagtttgcggtacgttagtaactacgttcgttcgtttaaccgtaaagttccggttctacgttccggaccgtccggttcgggtaaccccggg

SEQ ID NO: 424753 - DNA, 636 bp, Homo sapiens
  misc_feature: GZ8MTXP01A47FE.44.27.C05.1.454.CMB.2.raw
  modified_base (189)..(189): a, c, t, g, unknown or other
  modified_base (197)..(197): a, c, t, g, unknown or other
  modified_base (232)..(232): a, c, t, g, unknown or other
  modified_base (259)..(259): a, c, t, g, unknown or other
  modified_base (261)..(261): a, c, t, g, unknown or other
  modified_base (274)..(274): a, c, t, g, unknown or other
  modified_base (335)..(335): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacngtcggtcacatctctgcatggagccagtcgtaatnttcttagtcttattgtctctgtatcanancatcaagtaaacncccaaatcatcatctatgacgactataacgacgtccctagtagggtttactagtcgtctcncctcgactacgacgtcccggaacaaccgtccggccctaccgtacaacctacttccgtacggtcgggcctaccggtacggacgtacggaacgggacgacggtacgttagtaatttagtttattcggttacgtcctagtaagttacgtttcgtccgtcctactaattcttaacgtttagtcgttaccggttaggaaacgggttaacggaaccgttaaggttacccaccggttaccgtacgttaccgaccgttacccgaaccggtaccccaaccgtctacgttacctaaccgttcttaaccccg

SEQ ID NO: 424754 - DNA, 614 bp, Homo sapiens
  misc_feature: GZ8MTXP01BYC2R.44.27.C05.1.454.CMB.2.raw
  modified_base (223)..(223): a, c, t, g, unknown or other
  modified_base (267)..(267): a, c, t, g, unknown or other
  modified_base (282)..(282): a, c, t, g, unknown or other
  modified_base (359)..(359): a, c, t, g, unknown or other
  modified_base (368)..(368): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacagtcggtcaccatctcctgcactgganccagcgtaatattcttagtcttaactttgtctctgtatcaacancatccaaggtaaacncccccaaactcatcatctatgagcctaataagagccctgagggtttctaatcgcttcacctgctcagtccgacaacncgcctcccngacatctctcgggctccgaggctgaggacggaggctagtatttattagttgtgtctacgtaggttagttcggttccgtcgtactacgttacgtaaccttttgtcgtttacgtttaccgggaaggttaacggggaacccgttaaagggttcccttaacccggttaccgttacgggttacccacggaccccgaacgggacccccaaaccccctacgttcgttaccctaaccgttccgtttaaccccgg

SEQ ID NO: 424755 - DNA, 556 bp, Homo sapiens
  misc_feature: GZ8MTXP01DL5VT.44.27.C05.1.454.CMB.2.raw
  modified_base (236)..(236): a, c, t, g, unknown or other
  modified_base (266)..(267): a, c, t, g, unknown or other
  modified_base (281)..(281): a, c, t, g, unknown or other
  modified_base (309)..(309): a, c, t, g, unknown or other
  modified_base (370)..(370): a, c, t, g, unknown or other
  modified_base (431)..(431): a, c, t, g, unknown or other
  modified_base (515)..(515): a, c, t, g, unknown or other
  modified_base (535)..(535): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatnttcttagtcttaacttgtctctgtatcaanncatccaggtaaacnccccaaactcatcatctatgagcctaanaagacggtcccttacgaggggtttactaatcgcttcactcgcctcaacgtccggaacaacncggcctacctgacatctcgtcgggctcgagcgtgacggacgaggctagtattattattgtncttgagtagttcgttcgcgctatactacttgtcgtctacgggaagttcggacgttaaacggtccaaccgttcgtacgggttacncgacccgaacgcccaacccnctcgttactcttcgttccccg

SEQ ID NO: 424756 - DNA, 739 bp, Homo sapiens
  misc_feature: GZ8MTXP01DOBH5.44.27.C05.1.454.CMB.2.raw
  modified_base (314)..(314): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtagggggtccctgagactctcctgtgcagcctcgtggtatccaccttgaattaaagttggaatagtgcaggtcgggtccncaggcctcgaggcgagggggctggagtgggtggcgaggtgtgtctattcgtagtaggaaggaaagtaacgtaagtcgttacgggtagtacgttccggttaggtacggggtaccgtacgttacctacctaactacctaccgaacggaacggaaaccgtaaacttacccgtaacggaaaccaaaccgtaacgtacgttaccttaccgttaaccgtaaaacttaaagtaaacgtaaaccgtacccgtacggtaaccgtaaacccgtaccgtaaccgggtaaccggaacccgggtacccggttaacggtttaacgttttacggttaggttacggtaaccggtaagttaacgttactttacgtttaaccgttaaaacgttaaccggttacgttacgttaccggtaaccggttaaccggttaacccggggg

SEQ ID NO: 424757 - DNA, 631 bp, Homo sapiens
  misc_feature: GZ8MTXP01A4SN8.44.27.C05.1.454.CMB.2.raw
  modified_base (189)..(189): a, c, t, g, unknown or other
  modified_base (454)..(454): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatctctgcacgtgggtccagcaatgactagttgggatatatacttgtctctgtatcaacaacatccaggacaaacgacccccaaactctattacttttagagtccagtgacgcggtccgtgtaggttgtttactaagtcgtctttcctcgtggtctcctaagtccgtacggcccacacccgggtccctcccgtgtcgactcgtcgtcggcctccggctggacggacgacggtctagtacttattacgngccggtctactactttaacaacgttcgttagacggtacgtttggggtcggttccgggacgggacgggtactccgaaccgttcgtacccgttcgtacgggtccaccgggttaccccaaacgggaacccctaaccccgtaacgttccgtaccttaccttcccgttccgtttaacccccc

SEQ ID NO: 424758 - DNA, 714 bp, Homo sapiens
  misc_feature: GZ8MTXP01DAVLV.44.27.C05.1.454.CMB.2.raw
  modified_base (276)..(276): a, c, t, g, unknown or other
  modified_base (321)..(321): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcggtggaggtcggtggggggaggcggtcgggcccccgagggtacggggggtccctgacgactctctgtgcagcctntggtattcacttcgaataattggaattatgctaggtcggggtccnccgaggctccgagggcgagggggcgtgggagtgggggtgcgaggttgtgtctatttcagtggaggtaaatcgaaaagttctaacgggtgtacgtttcccgggttggacggggccgtaagtttcccacctatcctaccaggacgaaacctaagttacccgaaagtaaaccaacgagttacgttacttacctttaacaaaacttacggaaacctacgtaccgttacggaacgtaccccgtaccggaacgggtaacccgtacccgggtacccggtttggtttaacgtttttggacgtacggttacggtaacttacgttacgtttcgtttaaccctaaaacgtttccggttaactacgttacccggttacggtccccggttcgggggtaaccccggg

SEQ ID NO: 424759 - DNA, 820 bp, Homo sapiens
  misc_feature: GZ8MTXP01CG1KZ.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcgtggagtcgtgggggaggcgtcggcccgaggtacggggggtccctgacgactctccggtgcgacgctctgctctacctcgtataagtagtaatatgcgagtgggtccgcgacggcgtcgacggcggagggggcggtagggaggtgggggtgggtcgagggtggttggtctacgtttcgtacgtagggagggtaaagtacgtaacgtaacgttaaccggtggtacgtttcgggttacggtacggggtacccgtacggtttacctaaccctacgttacccttacccgaacggtaacggtaaaccgttaaaccgttacccggtaacggaaaccgtaaaccgtacggttacgttaccggttaccgttaacttaaaacggtaacggttaaaccgaacgtacccgtacggttaacggaaccccgtacgtaaaccggggtacccgtaacccggggttacccgtttacggtttacgtttttaacggttacgggttcggttaaccgggttactttaaaccggttactttacggtttacccgtttaaaaacgttcccgggtttacgttaacgtttaccgggtacccggttacccgttaaccgggggttaacccgttaaaccccggggg

SEQ ID NO: 424760 - DNA, 671 bp, Homo sapiens
  misc_feature: GZ8MTXP01D5EZ3.44.27.C05.1.454.CMB.2.raw
  modified_base (248)..(248): a, c, t, g, unknown or other
  modified_base (654)..(654): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtcctgagactctcctgtgcagcctntgattcaccttgaatatgaatatgcagtggccgcaggctacgaggcgagggctggagtggggtgcagggtgtgtctatttcagtgggaaggtaaatcgaaagtccgtaagggtgtactttccggttaggacggggaccctaatttccaaccctattaccctaccgaaaggaacgaaactaaacttacccggaagtaaaaccaacgacggttacgttacttactttaactaaaacgtagaaacctaaggacctaggaaccgtaaccgtaaccgaagggtaaccaccggggttacccggttgtttacgttttttgacggtccgtaaagtactacgttctaacgtttaaccttaaaagtccggttactacgttacgacgttcggttcgggcgaacggaaccgtcggtcncccgtcttcccgtcccg

SEQ ID NO: 424761 - DNA, 643 bp, Homo sapiens
  misc_feature: GZ8MTXP01AGGE9.44.27.C05.1.454.CMB.2.raw
  modified_base (303)..(303): a, c, t, g, unknown or other
  modified_base (570)..(570): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggcttcaccttcgataattggaatatgcaggtcggtccncaggcctcgagggcgaggggctgggaggtggggtggcgagggttgtgtacagtttccagtgggaagaaatcgaaaagttccgttaacggtgtaacgtttccgggttgacgggggtccctagtttccaacccgtatcctacccgaaggaacgaactaaacgttaccgaacgtaaacgacctaagtcgttacttacttaacaaagtacggaaactacgcctagaacgacctacgacggaccgtaacggtccgttaggttaacttttggngtaccgagtacgttattcgttcgtttaccaaaacttcggtaactacgttccggacgtcggttcgggaacccgg

SEQ ID NO: 424762 - DNA, 595 bp, Homo sapiens
  misc_feature: GZ8MTXP01BZMLD.44.27.C05.1.454.CMB.2.raw
  modified_base (189)..(189): a, c, t, g, unknown or other
  modified_base (223)..(223): a, c, t, g, unknown or other
  modified_base (264)..(265): a, c, t, g, unknown or other
  modified_base (279)..(279): a, c, t, g, unknown or other
  modified_base (570)..(570): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaacttgtctctgtatcacnncatcaaggtaaacncccccaaatcatcatctatgagtcctagtacgacggcccttcgaggggttttctaatcgtcttcacctcgacctcgaagtcccggaacaacgccggcctaccctagactatctcgtgggctccgaggctaggacgggacgagggtctagtatttagttattgtgcttagagttagttcgttcgctcaacgttctaacgtttgtcgttaccgtttacgggaaggttcgggaacttaaggtcccgttaaccgttccgtagggttccacggaccccgaacgaccccaacccgtntcgttacctaacttcccgtttcccg

SEQ ID NO: 424763 - DNA, 645 bp, Homo sapiens
  misc_feature: GZ8MTXP01CFG8N.44.27.C05.1.454.CMB.2.raw
  modified_base (193)..(193): a, c, t, g, unknown or other
  modified_base (230)..(230): a, c, t, g, unknown or other
  modified_base (303)..(303): a, c, t, g, unknown or other
  modified_base (321)..(321): a, c, t, g, unknown or other
  modified_base (405)..(405): a, c, t, g, unknown or other
  modified_base (585)..(585): a, c, t, g, unknown or other
tcagacagtatatacacgaccggtgctcgatttagacgcgatcgaaggggtttgggggggggtcacaagaggcagcgctctcgggacgtctccaccatggcctgggctctgctgctcctcactctcctcacccaggacacagggtcctgggcccagtctgccctgactcagcctgcctccgtgtctggggtcncctggacaggtcggtcaccatcctctgcacgtggacnccaagtcggttaattattcttagttctttaactttcgtctccttggtatacaacatcataccaaggtaaaccnccccaaatcatcatctangagcctaagaagcgtccctagtagggtttacagtcgtctcacctcgactacgaacgtcccgaacaaccgccggcctacccgtanaaccatccgtacgtcgggtcctcgaggcgtggaacggtacgaggtactagtatttaagttgttgttgaccgtagtagttacgttcgtacgtactactattacttaccttgttacgggttcgtaacgggaaggttaaccgggaaaccttacgggtccaaccgggttactcgggttaacccncgaacccccgtaacgaacccctaaccccgtacgttccaccgtaaccttccgttcccccgg

SEQ ID NO: 424764 - DNA, 621 bp, Homo sapiens
  misc_feature: GZ8MTXP01C24TQ.44.27.C05.1.454.CMB.2.raw
  modified_base (306)..(306): a, c, t, g, unknown or other
  modified_base (396)..(396): a, c, t, g, unknown or other
  modified_base (485)..(485): a, c, t, g, unknown or other
  modified_base (543)..(543): a, c, t, g, unknown or other
  modified_base (557)..(557): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtggggggaggcgtggccccaggtacggggggtccctgagactctcctgtgcagcctctggattcaccttcgataattggaatatgcaggtcggtccncaggctccgaggcgaggggctgggaggtggggtggcgaggttgtgtctatttccgagtaggggagaaatcgaaaagttcgtaacggggtntacgtttaccggtgggacggggccgtattcccaccgtatcctacgagaacgaacaagttacccgaagaacactagtctacttacttaanaaactagaacagacctgacgaccgtcgacggaccgacggtccgttgttaacgttttgnggtacgaggtactnttacgttcgtttaccgtaaaattccggttaactacgttccggacgtccggttcggggtaacccg

SEQ ID NO: 424765 - DNA, 669 bp, Homo sapiens
  misc_feature: GZ8MTXP01ERLKZ.44.27.C05.1.454.CMB.2.raw
  modified_base (292)..(292): a, c, t, g, unknown or other
  modified_base (409)..(409): a, c, t, g, unknown or other
  modified_base (430)..(430): a, c, t, g, unknown or other
  modified_base (441)..(441): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggacttcaccttcgataattggaatntgcagtggtccgcaggctcgaggcgagggctgggagtggggtggcgaggttgtgtcatttcgagtggaagaatcgaaagttcgtaaggtgtacgtttcgtgagggccgtacttcacngtactcagacgactaatcganaacacgtagtntcgtacttacaaagtcgtaaacacgccgttagacgtaaccgtaccgaacggtaccgtaaccgggtcccgtttaggtttaacgttttttacggttgggtacccggttaaaggttacccgttaaacgtttccgttttaaccggttttaccccgtaaaaagttttcccggggttaactttaacgggtttcccgttaaccgggtcccgggtttaacgggggtaaccccgggg

SEQ ID NO: 424766 - DNA, 798 bp, Homo sapiens
  misc_feature: GZ8MTXP01CYXS3.44.27.C05.1.454.CMB.2.raw
  modified_base (270)..(270): a, c, t, g, unknown or other
  modified_base (289)..(289): a, c, t, g, unknown or other
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacgggggtccctgagactctcctgtgcagcctctggntcacttcgataatggaatntgcaggtgggtccnccaggctccgagggcgaggggctgggagtgggtggcgaggtgtgtcatttccgagtggaggaaatcgtaaaagtctaacgggtgtaacgtttcccggttagggacggggtcccgtattacccacccgtactccgtaccgaagacgtaactaaacgttaccggaaacggaaacctaacgtaacgttacgttaccttaccgtttaacggtaaaacttacggaaaacctacggtacccgttaacggaaccggtaaccccgttaccggaaccggggtaacccgtaacccgggggttaccccggttttagggttttaaacgtttttttcgggttacgggtaaccggttaaacggtaaacccgtttaacgtttacccggttttaacggtttttaaacccccgtaaaaaacgggttttccccgggtttaacgttaacccgttttacccggggttaaaccccgggttccccggggttaaccggggggttaaaccccccggggg

SEQ ID NO: 424767 - DNA, 731 bp, Homo sapiens
  misc_feature: GZ8MTXP01BLKQ0.44.27.C05.1.454.CMB.2.raw
  modified_base (269)..(269): a, c, t, g, unknown or other
  modified_base (296)..(296): a, c, t, g, unknown or other
  modified_base (309)..(309): a, c, t, g, unknown or other
  modified_base (320)..(320): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcggtggccccgaggtacggggggtccctggagactctcctgtgcagccctnggtacttcaccttcgataatggaatangcaggtcggtccncgaggctccgnggcggaggggctgggaggtgggtggcgagggttgtcggtctagtttccgagtggaaggtaaatcgaaaagttcgtaacgggtgtacgttcccggttggacgggtctagttccactactcctaccagaacgaactaacgttacccgaaagtaaccgacgtaacgtcgttaccttaccttaacctaaagttacgaaaccgtaaccggtccgttacggaaccggtacccgtaccggaacggtaccgggtaacccgggttacggtttccggtttaaggttttttacggttcgggtaaccggttaaggtaacctttaacgtttacgtttaccggttttaacccgttaaaacgtttccggttaaccgttacggttacccggttacccgggtaacccgggttcgggggtaaccccggg

SEQ ID NO: 424768 - DNA, 597 bp, Homo sapiens
  misc_feature: GZ8MTXP01BT000.44.27.C05.1.454.CMB.2.raw
  modified_base (269)..(269): a, c, t, g, unknown or other
  modified_base (282)..(282): a, c, t, g, unknown or other
  modified_base (308)..(308): a, c, t, g, unknown or other
  modified_base (334)..(334): a, c, t, g, unknown or other
  modified_base (366)..(366): a, c, t, g, unknown or other
  modified_base (403)..(403): a, c, t, g, unknown or other
  modified_base (468)..(468): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtgggcccccaggtacggggggtccctgagactctcctgtgcagcctcnggacttcaccttnataattggaatatgcagtcgggtccncgaggctccgaggcgagggctagggngtgggtgcaggtgtgtcatttccagtgagaanctaaagtctgtgattccggtgagggcctattcacctntcctcgagagactaagttaccgacgaacacagtcgtctacttacggaaattggaaccacggtccngacgtacccgtacgacggaccgaaccggtccgttagttaagttttgacgtcggatacgttacgttcgttcgtttaccaagttaccgttcgtacgttaccgttaaccggtccgttcggggtaaccccggg

SEQ ID NO: 424769 - DNA, 642 bp, Homo sapiens
  misc_feature: GZ8MTXP01E4QPA.44.27.C05.1.454.CMB.2.raw
  modified_base (307)..(307): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctctgtgcagcctctggattccaccttcgaataattggaatatgcgaggtcgggtcccncaggcctccgagggcggagggggctgggaggtgggggtggcgtaggttgtgtctagtttccgaggtagggggaaatcgaagtcgtacgggtgtacgttccggtaggacggggcctattcacctctacctaccaagacgaactaacgttaccgaagaaaccacgtagtcgttaccttacttacaaaacgtcgaaacgacgaccgtagaacgacccgtacgacggaaccgtaccggtcccggttagtttagttttggcgacggtagttactattcttacgtttaccaaagttccggtactaacgttcgaccggcccggtcgggggccgtaaccgggg

SEQ ID NO: 424770 - DNA, 676 bp, Homo sapiens
  misc_feature: GZ8MTXP01DJ4O6.44.27.C05.1.454.CMB.2.raw
  modified_base (262)..(262): a, c, t, g, unknown or other
  modified_base (270)..(270): a, c, t, g, unknown or other
  modified_base (274)..(274): a, c, t, g, unknown or other
  modified_base (295)..(295): a, c, t, g, unknown or other
  modified_base (305)..(305): a, c, t, g, unknown or other
  modified_base (346)..(346): a, c, t, g, unknown or other
  modified_base (590)..(590): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgacaattcggtggagtcgtgggggacggcgtcggccccaggtaggggggtccctagagactctctgtncagtcctntggnttcaccttgataattggatangcagtggccncaggctccgaggtcggagggctggagtgggtagcgtaggtntgctcgtttacagtagggagaaagtcgaaaaaacgttcggttaaccgggtgttacgtttaccccgggttggaaacggggtcccggtaatttacccgaaccctaatcccgttaaccgaagtaacgaacgtaaacgtttaccgaaaggaaaccacgagttacggtaccttacttaaccgtaaagttacggaaacacggtccagaccggtactacgacgtaccgacggtaccgttgttaattttcgngtaccgaggtaacgtacttccgttacggtttacctaaaagttccgtcgttaacgtccgttacggtaaccggttccggggaacccgg

SEQ ID NO: 424771 - DNA, 632 bp, Homo sapiens
  misc_feature: GZ8MTXP01AMHDL.44.27.C05.1.454.CMB.2.raw
  modified_base (268)..(268): a, c, t, g, unknown or other
  modified_base (309)..(309): a, c, t, g, unknown or other
  modified_base (401)..(401): a, c, t, g, unknown or other
  modified_base (488)..(488): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagtcttgggttttcctcgttgccctcttaagaggtgtcatgtgtcaggtgctaattcgtggagtcgtgggggagcgtggccccaggtacgggggtccctgacgactctcctgtgcagcctntggattcacttgataattggaatatgcgtaggtcgggtccnccgaggcctaccgagggcggagggggctgggaggtcggggtggctaggtgtgtctatttccgagtggaacgaaatcgaaagttcgtaaggtnagttccggtaggacgggtcctagttccaccgtatcctaccgagacgactaacgtcgaagtaacactgtactctactacaatcgaacncgactagacgacctacgacggtacctacgggtccgttggtttaacgttttacggcgaccgttaaggtaccttagttacgttcgttaaacctaaagtttccgtaactaacgttccggaccggtccggttaacggggtaaccccgg

SEQ ID NO: 424772 - DNA, 682 bp, Homo sapiens
  misc_feature: GZ8MTXP01DFXFG.44.27.C05.1.454.CMB.2.raw
  modified_base (306)..(306): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccaggtagggggtccctgagctctcctgtgcagcctctggtacttcaccttcgaataattggaatatgcaggtcgggtccnccgaggcctccgaggcggaggggcgtgggaggtggggtggcgtagggttgtgtctatttccgagttagggaaggtaaatcgtaaaaagttcgtaacggtgtacgtttcccgggtggaccggggtcctagttacccacctacgtcctaccgaagtacgaactaaacgttaccgaaggaaacctacgtaagttcgttaccttactttaaacggaaagttacggaaacctacgacctagacgtaccgtacgacggtaaccgtaccggtccgtttaggtttaacgttttggcgtacggttacttacgtacttacgttcggtttaaacctaaacgtttcggtctaacgttccggaccgtccggttaacgggggtaaccccg

SEQ ID NO: 424773 - DNA, 627 bp, Homo sapiens
  misc_feature: GZ8MTXP01A07FN.44.27.C05.1.454.CMB.2.raw
  modified_base (312)..(312): a, c, t, g, unknown or other
  modified_base (327)..(327): a, c, t, g, unknown or other
  modified_base (374)..(374): a, c, t, g, unknown or other
  modified_base (529)..(529): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagtcttgggttttcctcgttgcccttcttaagaggtgtcatgtgtcaggtgctaagttcggtggaggtcgtggggggaggcggtcggccccgaggtacggggggtccctgagtactctcctgtgcacgcctgtggtcttcaccttcgattaagttcggaatntgcaggtcgggtccncaggctccgaggcggagggctggaggtgggtggcgaggtgtgtactnttcgagtaggaagtaactacgtaagtccgttagggtgtaacgtttccggtgggacgggccgtattaccacctattccgtcgagacgaactaacgttaccgacgtaacactacgtagtccttacgtaacaactacgaacgaacgctagacgtaccncacggcctacggtccgtgtttacgttgtcgcgtacgtacttagttcttacgttaactaacgttcggtactacgttcgtaacgttcccggtaaccgggg

SEQ ID NO: 424774 - DNA, 734 bp, Homo sapiens
  misc_feature: GZ8MTXP01A56SQ.44.27.C05.1.454.CMB.2.raw
  modified_base (321)..(321): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaagttcggtggagtcgtgggggaggcggtcggccccgaggtacgggggtccctggacgactctctgtcgcagtcctgtggtattccaccttcgaataagttaggaatgtgcgaggtcgggtccncgacggctcgagggcggaggggctgggggaggtgggggtcggcgtagggttgttcgtactagtttccgaggtagggaaacggtaaatacgtaaaacggttcgtaacgggtcgttacgtttcccgggttaggaccggggtacctacgtttccacctacgtcctacgaagtacgaaacgtaacgttaccgaagaaaccgtacgtacgttacgttacctttaccttaacgtaaacgttacgaaaccgtacgtaccgtaggaaccgtaacccgtacggaaccgggtaccgtaccgggttccgtttaggtttaacgtttttcggacgtacgttaacgttacgttactttacgtttacgtttaacctaaacgttcggttaactcgtacggttaccgtccgggttaacgggaaccccggg

SEQ ID NO: 424775 - DNA, 785 bp, Homo sapiens
  misc_feature: GZ8MTXP01CW1HN.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgctaattcgtggagtcgtggggggaggcgtggccccgaggtacgggggtccctgacgactctcctgtgcacgcctcgtggacttccaccttcgaataagttggaaatagtgcgtaggtcggggtccgccgtaggcctccgaggggccggagggggcttagggggaggttgggggtgggacgtaggggttcgttgttcgtaattttccgaaggtaggggaaaggtaaaacttcgaaaaacggttcgttaacggggtgtacgtttcccgggttagggacgggggtccctaagttcccgacctactcctacccgaagaacgtaaacctaaacgttacccgaaacgtaaaccgacgtaacgttcgttacccttacgtttaaacctaaaagttaacggaaaccaacggtaccgtaacggaaccgtaacccgtacgaaccgggtaacccgtaccgggtacccggtttaggtttaagttttttcggacgtaccggttaacggtaacgttaactttaccgtttacggttttaacctaaaacgttaccgggtttctaacggttccgttaccgggtcccggttaacgggggtaaccccggg

SEQ ID NO: 424776 - DNA, 617 bp, Homo sapiens
  misc_feature: GZ8MTXP01BQX9B.44.27.C05.1.454.CMB.2.raw
  modified_base (207)..(207): a, c, t, g, unknown or other
  modified_base (224)..(224): a, c, t, g, unknown or other
  modified_base (298)..(298): a, c, t, g, unknown or other
  modified_base (315)..(315): a, c, t, g, unknown or other
  modified_base (318)..(318): a, c, t, g, unknown or other
  modified_base (351)..(351): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtcgtggtcgcctggacagtcgtcaccntctcctgcacgtggacnccagtcggtaattacttcttagttcctttaacgtttgtctcctaggtatacaacatcataccgaacggtaaacncccccaaatcatcactntangacgactagtagcgcctagtagggtttcagtcncgttcactcgctacgacgtccgaacaaccgccgtcctcccgagactacgtctcgcgggtctacgacggtcgtagggacgacggtagcgttagttaattatttagttgttcaccgttaggagtagttcgttcgcgctagttcctaaactttgtcgttaccggtggtaacggtcggaaaccttacgggtaccttccgtacgtcggttccgttaccgacccggaaccgtacccaacccgtagtccgttcctaaccgttccgtttccccg

SEQ ID NO: 424777 - DNA, 772 bp, Homo sapiens
  misc_feature: GZ8MTXP01AIUDP.44.27.C05.1.454.CMB.2.raw
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcggtggccccgagggtacgggggtccctgagactcgtcctgtgcagccctcgtggtacttccaccttgaattaattggaaattagtgacgtaggttcggggtccccgaccgaggtcccgtccgaaggggccggacgggggtcgttagggagggttgggggtaggcggtagggtcggtgtactagtttcgaaggttggggaaagtaaactcgaaaggttccgtaccgggttgtacggtttcccggtagggacggggtaacccctaattcccgaaccctagttcccgacccgaaggtaactaaaccgtaaacgttcccgaagtaaaccacgtacgttacgtacttacgttaacaaacttacgaacctacgtaccgtagaccgtaccgtacgacggaccgtacggtccgttagtttgtttggtacgtcgtaagtacttacgtcgtttaacttaaccgttaaacgtttcgggttactaacgtttcccggacccggttccggcccgggggtaacccgtaacgggtaaccccgtacggttcccgttaccccggttccgttccccgttcccccggg

SEQ ID NO: 424778 - DNA, 683 bp, Homo sapiens
  misc_feature: GZ8MTXP01CCXXW.44.27.C05.1.454.CMB.2.raw
  modified_base (267)..(267): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtcggccccgaggtagggggtccctgagactctcctgtgcagcctcnggattcaccttcgataattggaatatgcgagtcgggtccgcaggctccgaggcggaggggctgggaggtgggtggcgaggtgtgtctagtttccgagtagggaaggtaaatcgtaaaagttcgttaacgggtagtacgtttccgggttaggacggggtccgtaatttccgaacctacgtcctacgaagaagtaaaccgtaaacgtttaccgaaacgtaaccaacgtagtacgttacttaccttaacgaaaagttacgaaaccgacgtaccgtagaccgtacctaccgaacggtaccgtaacggtccgttgtttaacgttttggacggtacgttaaggtaacttacttacgtttactttaaccgtaaaacgttcggttctaacgttcggaaccggtccgttaacggggtaaccccgg

SEQ ID NO: 424779 - DNA, 628 bp, Homo sapiens
  misc_feature: GZ8MTXP01DA44Q.44.27.C05.1.454.CMB.2.raw
  modified_base (190)..(190): a, c, t, g, unknown or other
  modified_base (223)..(223): a, c, t, g, unknown or other
  modified_base (237)..(237): a, c, t, g, unknown or other
  modified_base (362)..(362): a, c, t, g, unknown or other
  modified_base (383)..(383): a, c, t, g, unknown or other
  modified_base (415)..(415): a, c, t, g, unknown or other
  modified_base (439)..(439): a, c, t, g, unknown or other
  modified_base (466)..(466): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactgganccagcggttaaatnttcttagtctttaactttgtctcctggtatcaaaccatcatccaggtaaacgacccccaaactcatcatctatgacgcctaataagagtccctgtagggggttttctaatacgtcttaccactcncctccaacgtcccgaccaacnccggcctccctacgacactctcgtcggtctcnggcgtgagacgagctgtattattntattgcctgacgtagttcgttcgtacnctattcttacctttagtcggttacgttacgggtaaaggtcgggtaaaccgttaaacgggttccttaacccggttaccgtaccggttacgaaccgaccccgaaaccgggtaccccctaaaccccggtacttaccgacccgttaaccttcccgtttaacccccg

SEQ ID NO: 424780 - DNA, 660 bp, Homo sapiens
  misc_feature: GZ8MTXP01A25VC.44.27.C05.1.454.CMB.2.raw
  modified_base (349)..(349): a, c, t, g, unknown or other
  modified_base (403)..(403): a, c, t, g, unknown or other
  modified_base (429)..(429): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtacggggggtccctgagtacctctccgtgtgcagccctgtggtacttcgaccttcgaataagttggaatatgcgaggtcgggtccgccaggcctccgagggcggagggggtctgggnggtgggtggcgtaggtgtgtctatttcgagtggaagaaatcgaaagttctggtnacgtttcggtgacgggctatccaccntctccgagacgaactaagtaccgaagaacctacgtagtcgttacttacgttaacaaaacgttacgaaaccgaacgtccgtaacgacgaaccccgttcggaacggaacccgtaccgggtaccgtttggtttaatttttggttacggtacgagtaacctttagttccgtttacgtttaacctaaaagttcggtaactacggttccgacggttaaccgttcgggggtaacccgg

SEQ ID NO: 424781 - DNA, 873 bp, Homo sapiens
  misc_feature: GZ8MTXP01E0HYA.44.27.C05.1.454.CMB.2.raw
  modified_base (281)..(281): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctggtcgcctggacagtcgtcaccatctcctgcactggagccagcggtaatattcttagtcttaactttgtctctggtatcaacatcatccagtaaacncccccaaactcatcatctatgacggcctaagtaaacggacggtcccccttacgtacggggggtttttactaaacgttccggccttttccgtaacccttccggaccctttaccccgaaacggttacccccgggaaccaaaccccgaacccgggtacccccttaccccgtacggaacctaaactttcccgttaccgttcggggggtccctttaccccgaacgggggtaccgttacggggaaacgggtaaccgggtaaaccggggtccgtttacgggtaaatttttaaaccggttttaaacgtttttgggtttacgggtaccctttcccggggtaaacggggttaaagtttccgggttttaccgggttcccgggttaccctacgtttacccttaaaccgttttaaaggtttcgttttcccggtttaaccgggggtaaagggttcccgggggtaaacccttaaaacgggggttccccgttaaccccgggtttacccgttaacgggttccccgttaaccggttaccccccggaaaccggggtaccccccaaaccccccgtacgtcggttaccctaacccgttcccgtttcccccggg

SEQ ID NO: 424782 - DNA, 595 bp, Homo sapiens
  misc_feature: GZ8MTXP01BYQT4.44.27.C05.1.454.CMB.2.raw
  modified_base (293)..(293): a, c, t, g, unknown or other
  modified_base (302)..(302): a, c, t, g, unknown or other
  modified_base (311)..(311): a, c, t, g, unknown or other
tcagacagtatatacacgaccggtgctcgatttagacgcgatcgaagggtttgggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgtaggtacggggggtccctgagactctcctgtgcagcctctgattcacttgatatgatangcagtggcncaggctcgnggcgagggctgggagtggtgcgaggtgtgtctagttcagtaggagtaaatcaagttctacgggtgactttccggtgaacggggccctattccactatctacgagagaacaacttcgagaaacactagtcgtaccttagttaacaaagttcgaaacgacgtaccccgtaggaacgaccgtccgagggacctaccggtcgttaagttacttttggacgcgagtacttcttcgttacgtttaaccaaagttcggttacacgtttccggaacgttccgtaaccggggg

SEQ ID NO: 424783 - DNA, 711 bp, Homo sapiens
  misc_feature: GZ8MTXP01C217I.44.27.C05.1.454.CMB.2.raw
  modified_base (321)..(321): a, c, t, g, unknown or other
  modified_base (439)..(439): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgacaattcggtggagtcgtgggggagcggtcggccccgaggtacgggggtccctgagacctctcctgtcgcagcctctggtacttcaccttcgaataagttaggaattatgacgtaggtcgggcccncaaggcctaccgagggcggtagggggctgggggacggtggggtcggcgtagggttgttaggtctagttttacccgagttacgggaaggtaaactcgaaaacggttcgtaacggggttntaaccggtttcccgggtagggaccgggtacgtacttccgactacttcgaccgaagacgaaactaacttaccggaaataaccgactacggttcttacgttacctttaaaccaaagttaccggaaactacgacccgtgaacgtacctcgacgtacgacgtcgttagtttaagttttgcggtacgacgttaacttacgttcgtttacgttacccaaagtttccggtttaactaaggttccccggttaacggtcccggttcggggtaaaccccggg

SEQ ID NO: 424784 - DNA, 535 bp, Homo sapiens
  misc_feature: GZ8MTXP01BBXR6.44.27.C05.1.454.CMB.2.raw
  modified_base (189)..(189): a, c, t, g, unknown or other
  modified_base (230)..(230): a, c, t, g, unknown or other
  modified_base (244)..(244): a, c, t, g, unknown or other
  modified_base (256)..(256): a, c, t, g, unknown or other
  modified_base (258)..(258): a, c, t, g, unknown or other
  modified_base (276)..(276): a, c, t, g, unknown or other
  modified_base (293)..(293): a, c, t, g, unknown or other
  modified_base (298)..(298): a, c, t, g, unknown or other
  modified_base (349)..(349): a, c, t, g, unknown or other
  modified_base (364)..(364): a, c, t, g, unknown or other
  modified_base (380)..(380): a, c, t, g, unknown or other
  modified_base (408)..(409): a, c, t, g, unknown or other
  modified_base (419)..(419): a, c, t, g, unknown or other
  modified_base (437)..(437): a, c, t, g, unknown or other
  modified_base (517)..(517): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcacatctctgcactgagcagcgtaatnttctagtcttattntctctgtatcanancatcagtaacacccaaancatcatctatgagctanaacgngccctagtacgggtttactaatcgtctcacctcgctacgacgtccgacacncgcctccagacatcngtacggctcgaggtcnggagtagacggtatgtattatattggtnntacgtaagtnttcgtacgtcgctaactntaaccttgtgttacgtacggaaggttcggaacgttaaggcgttaccgtcgtaagccgacgccaacggcccaaccacgtcnccgtaacttcgttccccg

SEQ ID NO: 424785 - DNA, 710 bp, Homo sapiens
  misc_feature: GZ8MTXP01ASQM3.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggaggcggtcggccccgagggtacgggggtccctggacgtactctcctgtgcagcctctgatcacttgataatggaatatgctaggtcggtcccgccgaggcctcgaggcggaggggcgtgggagggtcgggtggcgaggtgtgtctattcgagtagggaagaaatcgtaagtcggtacggtgtacgtttccgggtaggacggggtacctattacccgacctacgtacctaccgaaggaacgtaacgtaaacttaccggaaacgaaaccacgtagttacgttaccttaaccttaacgtaaatacgaaacgacgtaccgtacgaaccgtaacccgtaccgaacgggacccgtaccgggttcccgggtttaagttttacgtttttcgggtacgttaccggtaacgtaacgttacgttccgttaacgtttaacccgtaaaagtttccggtttactaccggtttaccggtaacccggttccgggtaacccggggg

SEQ ID NO: 424786 - DNA, 594 bp, Homo sapiens
  misc_feature: GZ8MTXP01A8OZM.44.27.C05.1.454.CMB.2.raw
  modified_base (189)..(189): a, c, t, g, unknown or other
  modified_base (229)..(229): a, c, t, g, unknown or other
  modified_base (244)..(244): a, c, t, g, unknown or other
  modified_base (338)..(338): a, c, t, g, unknown or other
  modified_base (543)..(543): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcnctggacagtcgatcaccatctcctgcattggaactaatcngatgttagaaaattntaaccttgtctcttggtaccaagtacacccacggtaaacccccaaactccttactttatgaagtcaataacgcggaccctcggggcatttcctnactcgtcttctcaggctccaacgtctggacaacacggacctcgttgattaaactttcgtcggtcctccgtcgcccttagacgaacggaggccgacttattatgcttgcttcatatcggcgggggtctaggtaatggttgggttccgttcgggcggaacgggggtccgaccgtggaaccgtcgtaacggtcacgccaaggtcctcnccccgttcgttcgaaccttcgtaacttccccaccttcctaacttcttaacc

SEQ ID NO: 424787 - DNA, 633 bp, Homo sapiens
  misc_feature: GZ8MTXP01BJ2VQ.44.27.C05.1.454.CMB.2.raw
  modified_base (190)..(190): a, c, t, g, unknown or other
  modified_base (224)..(224): a, c, t, g, unknown or other
  modified_base (268)..(268): a, c, t, g, unknown or other
  modified_base (286)..(286): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagttcttaactttgtctctgtatcaanatcataccaaggtaaacncccccaaatcatacatctatgacgctaataagcggtccctgtagggtttactaatcgcttcacctcgcctacaacggtcccgaacaaaccgccggccctcccgtagaacctatcgtcgtcgggtcctcgaggctaggacggacgtacgggcttaggtatttaattgttgttgtcttacgggagtttagtcgttcgtcgctagtcttaactttgtacgtcgtttaccggaagggtcccgggtaacttaacgggtcccttaccggttacccgtaaggttccccgacgaccccgtaaaccggcccctaaaaccccgtgttccgttacctaacccgtttccgttaaccccg

SEQ ID NO: 424788 - DNA, 644 bp, Homo sapiens
  misc_feature: GZ8MTXP01AUCYL.44.27.C05.1.454.CMB.2.raw
  modified_base (308)..(308): a, c, t, g, unknown or other
  modified_base (562)..(562): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtcggccccgaggtagggggtccctgagactctcctgtgcagcctctggattcaccttcgataattggaatatgcaggtcgggtccncaggctccgaggcggaggggctgggagtggggtggctaggtgtgtctatttccgagtggaagaatcgtaaaagtcgtaacggtgtacgtttcccgttggacgggtcccgtatttcccgacctactccgtccgaagtacgaactaacgttccgaagaaccaccgtagttcgttacttaccttaacaaagttcgaaaccgacggacctacgacgaccctacgaacgaccgtaccggtaccgttgttaacgttttgnggtacgttagtactacgttacgttcgttaacctaaaagtccggttaactacgttccggaaccgtccggttcggggaacccgg

SEQ ID NO: 424789 - DNA, 627 bp, Homo sapiens
  misc_feature: GZ8MTXP01AH7HJ.44.27.C05.1.454.CMB.2.raw
  modified_base (330)..(330): a, c, t, g, unknown or other
  modified_base (332)..(332): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggactgagctgggttttcctcgttgccctcttaagaggtgtcatgtgtcaggtgcaattcgtggagtctgggggagcgtggccccagtagggggtccctgagactctctgtgcagcctctggatcacctgataattggaatactgcagtgggtccgcaggctcaggcgtaggggctggagtgggtcggngngtgtgtctattacgtagtaggaaggaaacgtacgaaacgtacgtcggtagtacgttacgtaggacggacgtactacactactactacacgaacgaacgtaacgtacgaacgaacgaacgacgtacgtactactaacgtaaagtaacgaacgaacgaccgtacgacgaacgtaccgacggtaaccgtaccggtaccgttacgttaagtttgttgtacgttacgtacgttacttacgttcgttaaccgtaaacttacgttaacgtacgtaccgttaccgtccggttcgggtaaccgg

SEQ ID NO: 424790 - DNA, 642 bp, Homo sapiens
  misc_feature: GZ8MTXP01CXCE1.44.27.C05.1.454.CMB.2.raw
  modified_base (196)..(196): a, c, t, g, unknown or other
  modified_base (299)..(299): a, c, t, g, unknown or other
  modified_base (313)..(313): a, c, t, g, unknown or other
  modified_base (330)..(330): a, c, t, g, unknown or other
  modified_base (362)..(362): a, c, t, g, unknown or other
  modified_base (554)..(554): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgcccttcttaagaggtgtcatgtgtcaggtncaattcgtggagtcgtgggggagcgtggccccgaggtacggggggtccctggacgtactctcctgtcgcacgtcctctggattcaccttgaataagtggaatngcgaggtcggtccncgaggctccgaggcggnggggctgggacggtgggtggctagggtgtgtntatttccaggttggaaggaaatcgaaaagttcgttaacgggtgtaacgttccggttaggagggccgtattccaccgtatcctacagagaacaattccgaagaaccacgtacgtgtaccttacgttacaaattacgaaactacgactacgacgacctcgaacggtacctacggtccgttgttaacgttttggngtacggacgtactagttaccgttacgtttaccgtaaaagttccggttaacgtacgttccggaccgtccggttaacggggtaaccccgg

SEQ ID NO: 424791 - DNA, 674 bp, Homo sapiens
  misc_feature: GZ8MTXP01ERJBL.44.27.C05.1.454.CMB.2.raw
  modified_base (308)..(308): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctcgtggacttcaccttgataagttggaatatgcaggtcgggtcccnccgaggcctccgagggcggagggggctggggacggtggggtggcgtagggttgtggtactagtttccgaggttagggaagtaaatcgtaaaaggtcttaacgggtgtacgtttcccgggttaggacggggtcccgagtttcccaccctaagttcctaccgagaacgtaacgtaaacgttaccgaaacgaacacgtacgttacgtaccttaccgttaacaaagttacgaaacacgtacctagacgacctacgacggtacgaccggtccgttgttaattttcggttcgtacgttagtaacttacttcgttcgtttaacctaaagttccggtaactacgtccggaccgtccgggttcggggtaacccgg

SEQ ID NO: 424792 - DNA, 648 bp, Homo sapiens
  misc_feature: GZ8MTXP01AMHR7.44.27.C05.1.454.CMB.2.raw
  modified_base (189)..(189): a, c, t, g, unknown or other
  modified_base (196)..(196): a, c, t, g, unknown or other
  modified_base (206)..(206): a, c, t, g, unknown or other
  modified_base (220)..(220): a, c, t, g, unknown or other
  modified_base (234)..(234): a, c, t, g, unknown or other
  modified_base (268)..(268): a, c, t, g, unknown or other
  modified_base (315)..(315): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcnctggacngtcgtcaccntctctgcagtgganccagacgttaattnttcttagttcttactttgtctctggtatcaacancatccgaacggtaaacgaccccaaactcatcatctatgagtactaanaacgcgccctgtagggtttctaatcgcttcacctcgcctacaacgtccgaacaaccgccgcctcccagactactcgtacgtcggcctcgagtcgtaggacggacgaggtcttagtactttattacgtttgttcgtcttacgagttagttcgttcgtcgtactacttaccgtttaacttagttcgttacggttacggtaacgggtaacgggtaaccgttaaacgggttccttaacccggttcggtaaccggttaccgttaccgaccccggtaaccggtacccccaaacccgttccggttacgttacccttaaccgttaaccccgttttcccccg

SEQ ID NO: 424793 - DNA, 630 bp, Homo sapiens
  misc_feature: GZ8MTXP01CD50E.44.27.C05.1.454.CMB.2.raw
  modified_base (193)..(193): a, c, t, g, unknown or other
  modified_base (232)..(232): a, c, t, g, unknown or other
  modified_base (309)..(309): a, c, t, g, unknown or other
  modified_base (327)..(327): a, c, t, g, unknown or other
  modified_base (479)..(479): a, c, t, g, unknown or other
  modified_base (492)..(492): a, c, t, g, unknown or other
  modified_base (502)..(502): a, c, t, g, unknown or other
  modified_base (515)..(515): a, c, t, g, unknown or other
tcagacagtatatacacgaccggtgctcgatttagacgcgatcgaaggggtttgggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncgtggacaggtcggtcacactcctcctgcaacgtggacnccgaggtcgttaaatattcgttagtctttaatttcgtactcgtagtactacaactatcactcctaacggtaaaaccnccccaaatcatcatctangacgtactaagtagacgtccttagtagggtttactaacgtcgtcttcgaccctcgacctacgaacgtcccggaaccaaccgcggtccctaccgtacgaactactcgtcgtcgggactcgaggcgtagcggagagtctagtattattgttatntcttagaaggttnttcgttcgtnctatctaacgttnttcgtacgttagggaacgggtaacggtaaccgttacgtcttaccggtagtcggacgccggttaaccccaacgggaacccctaacctcggtaccttaccgtcccttaacgtccccg

SEQ ID NO: 424794 - DNA, 551 bp, Homo sapiens
  misc_feature: GZ8MTXP01AYTUE.44.27.C05.1.454.CMB.2.raw
  modified_base (233)..(233): a, c, t, g, unknown or other
  modified_base (263)..(263): a, c, t, g, unknown or other
  modified_base (278)..(278): a, c, t, g, unknown or other
  modified_base (294)..(294): a, c, t, g, unknown or other
  modified_base (304)..(304): a, c, t, g, unknown or other
  modified_base (307)..(307): a, c, t, g, unknown or other
  modified_base (325)..(325): a, c, t, g, unknown or other
  modified_base (431)..(431): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacagtcggtcaccatctcctgcagtggagccagcgtaatnttctagtcttaattgtctctggtatcaacntcatccaggtaaacnccccaaactcatcatntatgagctanagngcctgagggttacatcgntcactgactacacgtcgacaaccgcgcctacctgacatctctagggctcgagtctggaagcgaggtctgtacttattatcgtgactcgagtcttagtcgtcgactntaccgtactttgtacgttacgttcggaaggtttcggaacttaaacggggtccttaccgtaccgttaacgggcttaccgccgaaacggccctaaccatcgttacaaccgttcgttaacccg

SEQ ID NO: 424795 - DNA, 680 bp, Homo sapiens
  misc_feature: GZ8MTXP01AN1HE.44.27.C05.1.454.CMB.2.raw
  modified_base (189)..(189): a, c, t, g, unknown or other
  modified_base (223)..(223): a, c, t, g, unknown or other
  modified_base (238)..(238): a, c, t, g, unknown or other
  modified_base (270)..(270): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtcgtggtcncctggacagtcgtcaccatctctgcacgtggacnccaggtacgtaattnttacttagttcttaacttgtctctgtatcaanatcataccaaggtaacaccccaaatcatcatctagtgacgtctaataacggacgtcccgtacggtagggtttctaacgtcgtctactacctcgcctaccgacggtcccggaaacaaccgtccgtccctaccctagactactcgtacgtcggtacctcgaggcgtaggacggagaggtactagtattattgtgttacgtctacggtagtacgttcgttccggtactctacttaccttacgttacgttaccggttaccgttacggggaaacggttaaccgggaaacggttaaccgggtccccgttaccggttaccggtaacggttacccgaaccccgaccccggaaacccgggtccccctaaaccccgtacggtaccgttacccgttaacccgttcccgtttaacccccccg

SEQ ID NO: 424796 - DNA, 641 bp, Homo sapiens
  misc_feature: GZ8MTXP01EW048.44.27.C05.1.454.CMB.2.raw
  modified_base (268)..(268): a, c, t, g, unknown or other
  modified_base (288)..(288): a, c, t, g, unknown or other
  modified_base (300)..(300): a, c, t, g, unknown or other
  modified_base (348)..(348): a, c, t, g, unknown or other
  modified_base (500)..(500): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggagcgtcggccccgagggtacgggggtccctgacgactctcctgtgcagcctntggatcacttgatatgaatngcagtcggtccncaggctcgaggcgagggggctgggaggtgggtggcgagggtgtgtctntttacagtaggagaatcaaaagttcgtaacgggtgtacgtttccggttaggacggggtccgtagttcccaccatccgtaccgaggaacggtaactaaactttaccggaaacgaacgaactagtcgtacttacgttactaaagttacgaaacncgactacgacgacctacgaacgaccgacgggtccgttgttaacgttttaggttcgtcgttaacgtacgttacttacgtttacgtttacctaaaagttcgttaacgtacgtccggttaccgtccggttaacggggaacccgg

SEQ ID NO: 424797 - DNA, 638 bp, Homo sapiens
  misc_feature: GZ8MTXP01DWXDV.44.27.C05.1.454.CMB.2.raw
  modified_base (190)..(190): a, c, t, g, unknown or other
  modified_base (198)..(198): a, c, t, g, unknown or other
  modified_base (236)..(236): a, c, t, g, unknown or other
  modified_base (309)..(309): a, c, t, g, unknown or other
  modified_base (384)..(384): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacngtcgtcaccatctctgcacgtggagccagcgttaaatnttcttagttctttaacttgtactcgtggtatcaacatcataccaacggtaaacgccccaaatcatcatactangagtacctaagtaacgacggccctagtagggtttactaatcgtcttcacctcgactcaacgtcccgaaacaaccncggtccctccgtacaactactccttcgcgggactccgaggcgtaggacggagacgtctagtattattagttgttagactgaagtgttcgtttcgctactacgttactaacttttgcgtttacggttaaccgggaagggttcgggtaaacccttaaggggtccccttaccggttaaccgtacgggttacccgaccgaccccgaaaccggacccccaacccggttactcgttcccttaaccgttcccgtttccccg

SEQ ID NO: 424798 - DNA, 614 bp, Homo sapiens
  misc_feature: GZ8MTXP01A60J0.44.27.C05.1.454.CMB.2.raw
  modified_base (188)..(188): a, c, t, g, unknown or other
  modified_base (206)..(206): a, c, t, g, unknown or other
  modified_base (248)..(248): a, c, t, g, unknown or other
  modified_base (260)..(260): a, c, t, g, unknown or other
  modified_base (412)..(412): a, c, t, g, unknown or other
  modified_base (484)..(484): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccntctcctgcactgagccagcgtaatattcttagtcttaacttntctctgtatcantcatccagtaacgccccaaactcatcatctatgagcctaagtaacgcgtccctgtagggtttctaagtcgtacttcacctgcctacctaaggtcccggaactaaccgccggtccctcccgtagacctattctcgtgggtccctcgacggtcnggtaacgggctaagggcttagtacttatttacgttgttgacgttcggtagtagtttcgttacggtcctactnttactaactttgtcgttacgtttccgggaaaggttcggaaacgttacggttccaaccgtttcgtacggttcgaccggttacccgaaaccggtaccctaacccgacgttcgttccctaacttccgtccccg

SEQ ID NO: 424799 - DNA, 624 bp, Homo sapiens
  misc_feature: GZ8MTXP01DKLC3.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtcgccaggctcaggcgagggctgggagtgggtggcgaggtgtgtcatttcgatggaaggtaaatcgaaaagttcgtaacggtgtaacgtttcccggttagaacggggccgtattaccaccctatcctccagacgactaaattccgaagaacacagtgtactcgttacaaagtagaaacacgaccttcgacgtaccgtaccgacggtaccgtaccggcccgttggtttaagttttcggttacggtccgttagtaactagttccgttgtttaaccctaaaagttccgggtttcctacgttacgaccggtccgttcgggggtaaccccgg

SEQ ID NO: 424800 - DNA, 508 bp, Homo sapiens
  misc_feature: GZ8MTXP02HJXOA.44.27.C05.1.454.CMB.2.raw
  modified_base (185)..(185): a, c, t, g, unknown or other
  modified_base (279)..(279): a, c, t, g, unknown or other
  modified_base (316)..(316): a, c, t, g, unknown or other
  modified_base (353)..(353): a, c, t, g, unknown or other
  modified_base (369)..(369): a, c, t, g, unknown or other
  modified_base (411)..(411): a, c, t, g, unknown or other
  modified_base (492)..(492): a, c, t, g, unknown or other
tcagacagtatatacacgaccggtgctcgatttagacgcgatcgaagggtttggggtcacaagaggcagcgctctcgggacgtctccaccatggcctgggctctgctgctcctcactctcctcacccaggacacaggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaanccccaaatcatcatctatgagcctataagaggccctnagggtttcaatcgcttcactgcctcaagtccgcaacncggcctcctgacatcnctgggctcaggctgagacgaggctgatttatattgttgcttnagtatgttcgcgcatctacttatgttcgtacggaagtcggacaaggtccaccgtctacgcacgacccaacgcccaaacccnctcgtccacttcgtcg

SEQ ID NO: 424801 - DNA, 515 bp, Homo sapiens
  misc_feature: GZ8MTXP02JYKC2.44.27.C05.1.454.CMB.2.raw
  modified_base (240)..(240): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgggtccagcaatgacattggganatataaccttgtctcctggtatcaacaacatccaggcaaagccccaaactcatacttttgagtccagtgagcggccgtcaggtgtttctaatcgcttctctggctcaagtctggccacacggcctccctgtcgatctctgggctccggcctgagacgaggctgactattactgcggctcatttacactcttgagtacttgggtgttcggcggagggactcgacctgaccgtctaggtcacgcccaaggccaacccactcgtcactctcgttcccc

SEQ ID NO: 424802 - DNA, 509 bp, Homo sapiens
  misc_feature: GZ8MTXP02GG74Z.44.27.C05.1.454.CMB.2.raw
  modified_base (282)..(282): a, c, t, g, unknown or other
  modified_base (319)..(319): a, c, t, g, unknown or other
  modified_base (359)..(359): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaanccccaaatcatcatctatgagcctataagaggccctnagggtttctaaatcgcttcacctgcctcaagtccgcaacncggcctccctgacaatctctgggctccaggctgaggacgaggctgattatattgttgctcagtatgtttcgcgcatcactttatgtcttcgggaatgggaccaaggtcaccgtctaggtcagcccaaggccaaacccactgtcactctcg

SEQ ID NO: 424803 - DNA, 550 bp, Homo sapiens
  misc_feature: GZ8MTXP02IC6Q3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataatggaatatgcagtggtccgcaggctcctggcgaggggctgggagtggggtggcaggtgtgtcatttccatggagaaatcaaagtctacgggtgtattcccggttgaggggcccgattccaccctatctccagagacaacttccgagaacacagtgtctcttacaaatgaacagcctgagacctcaggacacggccgtgttattttgtgcgtagactatcttgttacctaaaagttcggttacacttacgaccgtaccgtcggggacccg

SEQ ID NO: 424804 - DNA, 512 bp, Homo sapiens
  misc_feature: GZ8MTXP02GXWLK.44.27.C05.1.454.CMB.2.raw
  modified_base (222)..(222): a, c, t, g, unknown or other
  modified_base (319)..(319): a, c, t, g, unknown or other
  modified_base (358)..(358): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaagcccccaaatcatcatctatgagcctataagagccctnagggtttcaatcgcttcacctgcctcaagtccggcaacncggcctcctgacaatctctgggctccaggctgaggcgaggctgattatattgttgctcagatgttcgtcgcatcacttatgtcttcggaagtcgggaccaaggtcaccgtctaggtcagcccaaggcccaaaccccgactcgtccactctcccg

SEQ ID NO: 424805 - DNA, 567 bp, Homo sapiens
  misc_feature: GZ8MTXP02FRCGY.44.27.C05.1.454.CMB.2.raw
  modified_base (283)..(283): a, c, t, g, unknown or other
  modified_base (321)..(321): a, c, t, g, unknown or other
  modified_base (363)..(363): a, c, t, g, unknown or other
  modified_base (426)..(426): a, c, t, g, unknown or other
  modified_base (438)..(438): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacnccccaaactcatcatctatgagcctataagaggccctnaggggtttcaaatcgcttcacctgcctccaagtccggcaacncggcctccctgacaatctctgggctcaggctggagacgaggctagaattattattgttgctanagattgttcgtncatctactttatgttccgtaggaaggtcggaaaccgtaaaggtcctaaaccgttccgttaagggtccaacggaccccgaaacggaccccctaaaaccccctacgttaccgtacctaccgttccgttccg

SEQ ID NO: 424806 - DNA, 537 bp, Homo sapiens
  misc_feature: GZ8MTXP02H8SBH.44.27.C05.1.454.CMB.2.raw
  modified_base (188)..(188): a, c, t, g, unknown or other
  modified_base (318)..(318): a, c, t, g, unknown or other
  modified_base (356)..(356): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctggggtcncctggacagtcggtcaccatctcctgcactggagccagcggtaatattcttagtcttaactttgtctctggtatcaacatcatccaggtaaacgccccaaactcatcatctatgagcctataagagcctnagggttctaatcgctcacctgcctcaagtccgacaacnccgcctcctgacaatctctggctccaggctgaggacgagctgattattattgtgcttcagtattgttcgtcgcaatctacttatgtactttcgggaaagttcggggaaacctaagggtccaaccggttcctaaggtccaagccccaaaggcccaaacccccgatcgtaccacttcgtcccg

SEQ ID NO: 424807 - DNA, 552 bp, Homo sapiens
  misc_feature: GZ8MTXP02JX5KT.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccccttaagaggtgtcatgtgtcaggtgcaattcgtggagtctgggggaggcgtggccccaggtagggggtccctgagactctcctgtgcagcctctggattcaccttcgataattggaatatgcagtgggtccgcaggctccaggcgaggggctgggagtggggtggcaggtgtgtcatttccagtggaggaaatcaagtctacggtgattccgtgagggccattcaccatctcagagacatccgagaacacagtcgtactcttacaatagaacagcctagacgacctacgacggacacggccgtgttacttttgtgtacgagactatcgttacgtttacctaaaagtcggttactacttacgacgtccgtacggggacccg

SEQ ID NO: 424808 - DNA, 518 bp, Homo sapiens
  misc_feature: GZ8MTXP02I1AFG.44.27.C05.1.454.CMB.2.raw
  modified_base (188)..(188): a, c, t, g, unknown or other
  modified_base (358)..(358): a, c, t, g, unknown or other
  modified_base (431)..(431): a, c, t, g, unknown or other
tcagacagtatatacacgaccggtgctcgatttagacgcgatcgaagggtttggggtgtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaacgcccccaaatcatcatctatgagcctataagagccctcagggtttctaatcgcttccactgcctcaagtccgcacncgcctcctgacaatctctggctccaggctgagacgaggctgattattattgttgctacagtattgttcgtcgntatccattatgtcttacggaagtgggaccaaaggtccaaccgtctaggtcaacgcccaaggcccaaccccgactcgtaccacttccg

SEQ ID NO: 424809 - DNA, 522 bp, Homo sapiens
  misc_feature: GZ8MTXP02H2NFV.44.27.C05.1.454.CMB.2.raw
  modified_base (371)..(371): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctgggagtgggtggcaggtgtgtcatttccatggagaaatcaagtctgggtnattccgtgagggccattcaccatctcagagacaattccgagaacacagtgtctcttacaaatgaacagacctgagacctcgagacacggcgtgtatttgtgcgagactatctgttaccaaaagtcggttacattcgacgtccgtgggaccg

SEQ ID NO: 424810 - DNA, 521 bp, Homo sapiens
  misc_feature: GZ8MTXP02GK3A1.44.27.C05.1.454.CMB.2.raw
  modified_base (360)..(360): a, c, t, g, unknown or other
  modified_base (395)..(395): a, c, t, g, unknown or other
  modified_base (415)..(415): a, c, t, g, unknown or other
  modified_base (428)..(428): a, c, t, g, unknown or other
  modified_base (504)..(504): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgagcctataagagccctcaggggtttctaatcgcttcactgcctcaagtccgacaacncggcctcctgacaatctctggctcagctgagacgngctgtattatattgttgctnagtatgttcgtcnctatctacttatgtacttcggaagtcggaccaaggtccaccgttcctaggtcacgacccaaaggcccaaaccccgnttcgacctactctcccg

SEQ ID NO: 424811 - DNA, 581 bp, Homo sapiens
  misc_feature: GZ8MTXP02I9MKS.44.27.C05.1.454.CMB.2.raw
  modified_base (329)..(329): a, c, t, g, unknown or other
  modified_base (391)..(391): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgaggccgattcacatctccagagacaattccgagaacncagtgtctcttacaaatcgaaacagcctgagaacctcaggaccacggccgttgtatttttgngcgagactatctgtttaccaaaatcgttacattcgacgccgtcgggccgacgggaaccctggtccaccgtctccctcggcctcccaccgaacggcccacgtccggtcccttcccccgtcggcccgccccgtcgccctcccgaacggcgacctaacccgtcccgacggaccgaccacgacgccggccccgg

SEQ ID NO: 424812 - DNA, 520 bp, Homo sapiens
  misc_feature: GZ8MTXP02IE89Z.44.27.C05.1.454.CMB.2.raw
  modified_base (214)..(214): a, c, t, g, unknown or other
  modified_base (395)..(395): a, c, t, g, unknown or other
  modified_base (405)..(405): a, c, t, g, unknown or other
  modified_base (514)..(514): a, c, t, g, unknown or other
  modified_base (520)..(520): a, c, t, g, unknown or other
tcagacagtatatacacgaccggtgctcgatttagacgcgatcgaagggtttggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtnattccgttgaggccgattcacatctccagagacaattccgagaacacagtgtctcttcaaatgaacagcctgagacctcagacacggccgtgtattttgtgcgagactatctgttccaaaatcgtcattccgacgcctgggcaggacctgtccacgtctcctcgcctcaccacgggcccancgtctccccngccgcctcgctccagcgcaccctccgagacgcacgacgccggccctggggcctcggcctggtcaaggacctacgttcctatatacgtgtcctgagcggctggcacggcncatagn

SEQ ID NO: 424813 - DNA, 567 bp, Homo sapiens
  misc_feature: GZ8MTXP02G8SND.44.27.C05.1.454.CMB.2.raw
  modified_base (281)..(281): a, c, t, g, unknown or other
  modified_base (385)..(385): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgagggctggagtgggtgcaggtgtgtcatttcatggaggaaatcaagtctacggtnattccgtgaggccattcacatctcagagacaattccgagaacacagtgtctcttacaaatcgaacagcctgacgacctcaggacacgggccgtgttatttttgngcgagactatctgtttacaaagttcgttactattcgacgtccgtggggaccgagggtaaccctggtccaccgtcctccgtccggcctcccgaccaacgggcccacgtccgtccttccccgtcggccgcccctcggcctccgacggacgccaacccgtccgacgacgcacgacggccggcccg

SEQ ID NO: 424814 - DNA, 392 bp, Homo sapiens
  misc_feature: GZ8MTXP02HFYD3.44.27.C05.1.454.CMB.2.raw
  modified_base (280)..(280): a, c, t, g, unknown or other
  modified_base (284)..(284): a, c, t, g, unknown or other
  modified_base (287)..(288): a, c, t, g, unknown or other
  modified_base (290)..(290): a, c, t, g, unknown or other
  modified_base (294)..(294): a, c, t, g, unknown or other
  modified_base (299)..(299): a, c, t, g, unknown or other
  modified_base (304)..(304): a, c, t, g, unknown or other
  modified_base (309)..(309): a, c, t, g, unknown or other
  modified_base (353)..(353): a, c, t, g, unknown or other
  modified_base (382)..(392): a, c, t, g, unknown or other
tcagacagtatatacacgaccggtgctcgatttagacgcgatcgaagggtttgggacagagtcaccattaccgcggacgaatccacgagtacagcctacatggagctgagcgaggctgagatctagaagacacggccatctatttctgtgcgagagccctcgtcaactttcatagtccctctcatagtcccacacatggaaattggttcgacccctggggccagggaaccctggtcaccgtctcctcggcctccaccaaggcccatcggtcttcccccgngccnccnncncagncaccncgagncacgngccgccgtggctgctggacaaaggactactctatactactgtcngaggcggctggacgaaggacgacgatagnnnnnnnnnnn

SEQ ID NO: 424815 - DNA, 555 bp, Homo sapiens
  misc_feature: GZ8MTXP02IOXDE.44.27.C05.1.454.CMB.2.raw
  modified_base (266)..(266): a, c, t, g, unknown or other
  modified_base (303)..(303): a, c, t, g, unknown or other
  modified_base (431)..(431): a, c, t, g, unknown or other
  modified_base (444)..(444): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggtttcctcgttagccctcttaagaggtgtcatgtgtcaggtgcaattcgtggagtctgggggaggcgtggccccaggtagggggtccctgagactctcctgtgcagcctntggattcaccttgataattggaatatgcagtggtccnccaggctccgaggcgaggggctggagtggggtgcgagtgtgtgtattctagtggaggaagtacaagtcgtagtgtagtccgttgtaggcgtactctacactctccagagacatacgacgaacacagtntctctactaatanacacacgacgacgacacgacgacgacgtacgtacgttagtttgtcgtacgtacgtactacttacttacgttaacgtaacgttacgttacgtacgtacgtacgtacggtcgg

SEQ ID NO: 424816 - DNA, 535 bp, Homo sapiens
  misc_feature: GZ8MTXP02J0IWA.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggtttcctcgttagccctcttaagaggtgtcatgtgtcaggtgcaattcgtggagtctgggggaggcgtggccccagtaggggggtccctgagactctcctgtgcagccctctggattcaccttcgataattggaatatgcagtggtccgccaggctccaggcgaggggctggagtgggtgcaggtgtgtcatttcatggaggaaatcgaagtcgtacggtgattccgttgacggggcccgattcaccatctccagagacattccgagaacacagtagtctctacaatgaacagctgacgacctcgagacacggccgtagtatttgtgcgagactactcttagttcctaaaagttcggttactacttcgacgcgtcgggg

SEQ ID NO: 424817 - DNA, 554 bp, Homo sapiens
  misc_feature: GZ8MTXP02IXYOY.44.27.C05.1.454.CMB.2.raw
  modified_base (188)..(188): a, c, t, g, unknown or other
  modified_base (263)..(263): a, c, t, g, unknown or other
  modified_base (279)..(279): a, c, t, g, unknown or other
  modified_base (356)..(356): a, c, t, g, unknown or other
  modified_base (417)..(417): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaaatattcttagtcttaacttgtctcctggtatnaacatcatcagtaaanccccaaatcatcatctatgagcctataagagccctgagggtttctaaatcgcttcacctgcctcaagtccgacaacncggcctccctgacaatctctgggctccaggctgagacgaggctgattattattgttgcttntagtagtgttcgtcgtactactactacttattgttacgttacggtaaggtacggtaacgtaaacggtaccgtaccgtaccgtacgtacgacgaccgaaccgaacccaaaccctaacctacgtacctacctacctccg

SEQ ID NO: 424818 - DNA, 387 bp, Homo sapiens
  misc_feature: GZ8MTXP02JXKQR.44.27.C05.1.454.CMB.2.raw
  modified_base (279)..(279): a, c, t, g, unknown or other
  modified_base (307)..(307): a, c, t, g, unknown or other
  modified_base (382)..(387): a, c, t, g, unknown or other
tcagacagtatatacacgaccggtgctcgatttagacgcgatcgaagggtttgggacagagtcaccattaccgcggacgaatccacgagtacagcctacatggagctgagcgaggcgtgaaggatctgaagacacggccatctatttctgtgcgagagccctcgtcaactttcatagtccctctcatagtcccacacatggaaattggttcgacccctggggccagggaaccctggtcaccgtctcctcagcttccaccaaggcccatcggtctccccngcgccctgctccaggagcacctccgagngcacagcggccctgggctgcctggtcaaggactacttccatatactgtctgagcgggctgggcaaggcgcatagnnnnnn

SEQ ID NO: 424819 - DNA, 381 bp, Homo sapiens
  misc_feature: GZ8MTXP02IPUC3.44.27.C05.1.454.CMB.2.raw
  modified_base (377)..(381): a, c, t, g, unknown or other
tcagacagtatatacacgaccggtgctcgatttagacgcgatcgaagggtttgggacagagtcaccattaccgcggacgaatccacgagtacagcctacatggagctgagcgaggctgagatctgaagacacggccatctatttctgtgcgagagccctcgtcaactttcatagtccctctcatagtcccacacatggaaattggttcgacccctggggccagggaaccctggtcaccgtctcctcagctccaccaggcccatcggtcttcccctgcgcctgctccaggagccacctccgagagcacagcggccctgggctgcctggtcaaggctacttcctatatactgtctgagcgggctggcaaggcgcatagnnnnn

SEQ ID NO: 424820 - DNA, 542 bp, Homo sapiens
  misc_feature: GZ8MTXP02I8C69.44.27.C05.1.454.CMB.2.raw
  modified_base (320)..(320): a, c, t, g, unknown or other
  modified_base (358)..(358): a, c, t, g, unknown or other
  modified_base (365)..(365): a, c, t, g, unknown or other
  modified_base (373)..(373): a, c, t, g, unknown or other
  modified_base (433)..(433): a, c, t, g, unknown or other
  modified_base (528)..(528): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaatcatcatctatgagcctataagaggccctnaggggtttcaatcgcttcactcgcctcacgtcgacacncgcctcnacatctgnggctcaggctaggaggacgagctagtatttattattgttgcttcagtattcgttcggtcnctatctactttatcgttcttacgggaagttcgggaaccgtaaggtccgaccgttcgtacggcacgacccgaacggccccaaaccctcgtcgtacnccttcgtttacccg

SEQ ID NO: 424821 - DNA, 535 bp, Homo sapiens
  misc_feature: GZ8MTXP02JQNQ9.44.27.C05.1.454.CMB.2.raw
  modified_base (320)..(320): a, c, t, g, unknown or other
  modified_base (362)..(362): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagccccaaactcatcatctatgagcctataagaggccctnaggggtttctaatcgcttcacctgcctccaagtccgacaacncggcctcctgacatctctgggctcccaggctgaggacgaggctgatttattattgttgcttcagtattgttcgtcgcatcactttatgttcttgggaagttggggacccaaagggtccaaccgtccgtaggtccacgcccgaacggcccaaacccccgatcgtcactcttccg

SEQ ID NO: 424822 - DNA, 508 bp, Homo sapiens
  misc_feature: GZ8MTXP02FVFZS.44.27.C05.1.454.CMB.2.raw
  modified_base (318)..(318): a, c, t, g, unknown or other
  modified_base (359)..(359): a, c, t, g, unknown or other
  modified_base (417)..(417): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagccccaaactcatcatctatgagcctataagagccctnaggggtttctaatcgcttcacctgcctcaagtccggcaacncggcctcctgacaatctctgggctcaggctgaggacgaggctgattatattgttgctnagatgttcgtcgcatcactttatgtcttcggaagttcgggaccaggtcacgtctaggtcagcccaaggcccaacccactcgtcactctccg

SEQ ID NO: 424823 - DNA, 769 bp, Homo sapiens
  misc_feature: GZ8MTXP02H332Q.44.27.C05.1.454.CMB.2.raw
  modified_base (268)..(268): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctcnggattcaccttcgataattggaatatgcagtggtccgccaggctccgaggcggaggggctgggaggtggggtggcgagggtgtggtctagtttcgagtggggaaggtaaaatcgaaaggttctaacggggttgaacgttttcccgggttagaacgggggtccctaagttacctaacccaacgttccctacccgaaggacgtaaacctaaaacgtttacccggaaacggaaacccaccgtaaggttacggttaccgtttacctttaaccgttaaaaattacggtaaaaccgaacggtacccgttaacggtaacgaaccccgttacgaaaccgggtaaccgacccggggtacccggtttaggtttaaacgtttttttgggtacggtaccgggtaacggtaaaccgttactttaccgtttaccggttttaaacccctaaaaagtttaccggggtttacctaacggttttaccggaaacccggttccccgggttaacccgggggg

SEQ ID NO: 424824 - DNA, 535 bp, Homo sapiens
  misc_feature: GZ8MTXP02JNIK2.44.27.C05.1.454.CMB.2.raw
  modified_base (243)..(243): a, c, t, g, unknown or other
  modified_base (337)..(337): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctgactcaggacacagggacctgggcccagtccgccctgactcagccagcctccgtgtctgggtctcctggacagccgctcaccctctcctgcactggaactaatactgatgttggaaaatntaaccttgtctcttggtaccaagtactacccaggtaaacccccaactccttcttatgaagtcaataagcgccctcggcatttctcatcgcttcncagctccaagtcctggcaacacggcctcgttgataatttctggcctctgcctgacgacgaggccgactattattgctgctcatatgcggtcagattattgggtcttcgggcggtaggggaccgcgtgaccgtctaggtcacgcccaaggctcgcccctcggtccactcgtcgttacccacccttcctcctactactac

SEQ ID NO: 424825 - DNA, 538 bp, Homo sapiens
  misc_feature: GZ8MTXP02GAFY4.44.27.C05.1.454.CMB.2.raw
  modified_base (372)..(372): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtggtccgccaggctccaggcgaggggctgggagtgggtggcgaggtgtgtcatttccatggagaatcaagtctacggtnattccgtgagggccgattcaccatctccagagacaatccgagaacacagtgtctcttacaaatagaacagacctagacgacctcaggacacggccgtgtacttttgtgtcgagactactcttgttaccaaaagttcggttactacttacgacgccgtgggtacccg

SEQ ID NO: 424826 - DNA, 515 bp, Homo sapiens
  misc_feature: GZ8MTXP02IHAX7.44.27.C05.1.454.CMB.2.raw
  modified_base (223)..(223): a, c, t, g, unknown or other
  modified_base (235)..(235): a, c, t, g, unknown or other
  modified_base (360)..(360): a, c, t, g, unknown or other
  modified_base (378)..(378): a, c, t, g, unknown or other
  modified_base (415)..(415): a, c, t, g, unknown or other
  modified_base (428)..(428): a, c, t, g, unknown or other
  modified_base (483)..(483): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctccctcacccaggacacagggtcctgggcccagtctgccctgactcagcctgcctccgtgtctgggtcgcctggacagtcggtcaccatctcctgcactgganccagcggtaatnttctagtcttaactttgtctctggtatcaacatcatccagtaaacgcccccaaatcatcatctatgagcctataagagccctgagggtttctaatcgcttcactcgcctcaacgtccggacaacncggcctcctgacatctcngggctccagctgaggacgaggctgattatatgtgctnagtatgttcgtcncatctactttatgttcgttacgaaggttcggacaaggtcaccgtcgtacggtcancccgaaagcccaacccgctacgcactctcccg

SEQ ID NO: 424827 - DNA, 569 bp, Homo sapiens
  misc_feature: GZ8MTXP02J2FSO.44.27.C05.1.454.CMB.2.raw
  modified_base (282)..(282): a, c, t, g, unknown or other
  modified_base (312)..(312): a, c, t, g, unknown or other
  modified_base (365)..(365): a, c, t, g, unknown or other
  modified_base (394)..(394): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggagaaatcaagtctacggtnattccgtgagggccattcaccatctcaganacaatccgagaacacagtgtctcttacaaatcgaaacagcctagacgaccctnacgggaccacggtccgtagttatttttgngcgagtactatcttagttaccaaaatcggttacattcgacgtccgtcggggccgacgggacccgtggtccaccgtcctccgtcgcctccaccgacggcccacgtccgtccttccccgtcggccgcccgtcgcctccgacggcgccaaccgtccgacgacgcacgacgccggcccg

SEQ ID NO: 424828 - DNA, 585 bp, Homo sapiens
  misc_feature: GZ8MTXP02HA6RD.44.27.C05.1.454.CMB.2.raw
  modified_base (428)..(428): a, c, t, g, unknown or other
  modified_base (433)..(433): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcaggtggtccgcaggctccgaggcgaggggctgggagtgggtggcgaggtgtgtctatttccgagtggaggaaatcgaaagtctacgggtgtattccggttgacgggtccattccacatctccagagacatccganaacanagtgtctcttacaaatagaacacgcctagacgacctacgacggaccacggtccgttagtttaacgtttggtgtacggtagacttacttaccgttacgtttaacctaaaagttccggttactacgttaccgaccggtccgtcggggaacccgg

SEQ ID NO: 424829 - DNA, 525 bp, Homo sapiens
  misc_feature: GZ8MTXP02F7F3A.44.27.C05.1.454.CMB.2.raw
  modified_base (427)..(427): a, c, t, g, unknown or other
  modified_base (525)..(525): a, c, t, g, unknown or other
tcagacagtatatacacgaccggtgctcgatttagacgcgatcgaagggtttggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctctcaaatgaacagcctgagacctcaggacacggccgtgtattttgtgcgagactatctgtttccaaaatcggttcattccgacgcctggggccagggaaccctggtcaccgtctcctcgcctccaccaacgggcccatcggtctccccctgccgcccngctccagacgcacctccgagagcacagcgcccctgggctgcctggtcaaggctactcctatactactgtctgacgcggggctggcaaggcgcagtagn

SEQ ID NO: 424830 - DNA, 555 bp, Homo sapiens
  misc_feature: GZ8MTXP02G0JHS.44.27.C05.1.454.CMB.2.raw
  modified_base (360)..(360): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggaggcgtggccccagtaggggggtcccctgagactctcctgtgcagcctctggattcaccttcgataattggaatatgcagtgggtccgccaggctccaggcgaggggctgggagtggggtggcaggtgtgtcatttcatggaggaaatcaagtcacggtnattcgtgaggccattcaccatctccagagacaatccgagaacacagtgtctcttacaaatagaacagcctagagacctcagacacgggccgtgtattttgtgcgagtactatctgtttaccaaaattcggttacacttacgacgtccgtcgggaaccgacgggaacccgtggtaccgaccgtccgtccgtcccgg

SEQ ID NO: 424831 - DNA, 615 bp, Homo sapiens
  misc_feature: GZ8MTXP02ITZW3.44.27.C05.1.454.CMB.2.raw
  modified_base (300)..(300): a, c, t, g, unknown or other
  modified_base (452)..(452): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccncaggctccgaggcgaggggctgggagtggggtggcgaggtgtgtctatttccgagttggaaggaaatcgaaagttctacgggtgtacgttccgttagacgggtccgtaatttcccgacctatcctaccagacgacaagttccgaagaaccanacgtgtactctacaaatgaacagcctagacgacctacgacggacgacggccgttgttaacgttttggacgtacgtaacgtacttacgttacgttacgtttaaccgtaaaacgtttccgttaacgttacgttaccgtaccggtaccggtacggggtaaccccgg

SEQ ID NO: 424832 - DNA, 570 bp, Homo sapiens
  misc_feature: GZ8MTXP02G07MA.44.27.C05.1.454.CMB.2.raw
  modified_base (315)..(315): a, c, t, g, unknown or other
  modified_base (327)..(327): a, c, t, g, unknown or other
  modified_base (356)..(356): a, c, t, g, unknown or other
  modified_base (395)..(395): a, c, t, g, unknown or other
  modified_base (424)..(424): a, c, t, g, unknown or other
  modified_base (511)..(511): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggccgccaggctccaggcgaggggctgggagtgggtggcaggtgtgtcatttcagtggaggaaatcaagtctacggtgattccgtgaggccattcaccatctccaganacaattccgaanaacacagtgtctcttacaaaatcgaaacngcctgacgacctcaggaccacggtccgtgttatttttgngcgagactatctgttactaaaatcgttanattcgacgtccgtgggccacgggaaccctggtcaccgtctccctcggcctccaccgacggcccactccggtcctcccccgtcggccncccgtcgcctccgacggacgccaacccgtccggacgacggaccaccgacgccggcccgg

SEQ ID NO: 424833 - DNA, 522 bp, Homo sapiens
  misc_feature: GZ8MTXP02JNYML.44.27.C05.1.454.CMB.2.raw
  modified_base (480)..(480): a, c, t, g, unknown or other
tcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctcctggcgaggggctgggagtgggtggcaggtgtgtcatttccatggaggaaatcaaagtctacgggtgattccgtgagggccagttcaccatctccagagacaaattccgagaacacagtgtctcttacaaatgaacagacctgagacctcaggacacggccgtgtattttgngcgagactatctgttacaaagtcgtcatcgacgcctggaccg

SEQ ID NO: 424834 - DNA, 614 bp, Homo sapiens
  misc_feature: GZ8MTXP02G0VT2.44.27.C05.1.454.CMB.2.raw
  modified_base (304)..(304): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccaggtaggggggtccctgagactctcctgtgcagcctctggattcaccttgataattggaatatgcagtggtccncaggctcgaggcgagggctggagtgggtggcgaggtgtgtcgtatttctagtaggagaatacgtaagtacgtcggtagtagttcgtgtacggacgtactacactactctcagagaactaactaccgaacgaacaactagtacgtactacttaactaaactaacgaacgacgaccgtacgaacgtaccgtacgaacggaccgaccggtacgttacgtttacgtttagttagtacgtacgtactacttacgttacgttaacgttaaacgttacgttacgtacgttacgtaccggtaccggtacgggtaccgg

SEQ ID NO: 424835 - DNA, 511 bp, Homo sapiens
  misc_feature: GZ8MTXP02GYZLW.44.27.C05.1.454.CMB.2.raw
  modified_base (282)..(282): a, c, t, g, unknown or other
  modified_base (320)..(320): a, c, t, g, unknown or other
  modified_base (360)..(360): a, c, t, g, unknown or other
  modified_base (376)..(376): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaancccccaaatcatcatctatgaggcctataagagccctnaggggtttctaatcgcttcacctgcctcaagtccgcaacncggcctcctgacatcnctgggctcaggctgaggacgaggctgtattattattgttgcttcagtatgttcgtcgcatcactttatgtcttacggaagttgggaccaaggtcacgtctaggtcagcccaaggcccaacccatgtcactctccg

SEQ ID NO: 424836 - DNA, 730 bp, Homo sapiens
  misc_feature: GZ8MTXP02JMS5K.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatatgcagtggtccgcaggcctccgaggcgaggggctgggagtgggtgcgaggtgtggtcatttcattggaaggtaaatccaaagtctacgggtgtaacgttcccgttgacgggggtccctaatttccgaaccctaattccgtacccaaggtaacggaaacctaaacgtttacccggaaacgaaaaccaacgtaacggttacggttaccctttactttaaaccaaaagttacggaaacctaacgtacccgttacggaaccgaacccgttacgaacgggtaaccgacccgggtaccccggtttacggtttaacgtttttgggtacggtaccggtaaaggtaacgtttaacttaccgtttaacggttttaacctaaaaaacgtttccggggtttaaccttaacgtttaccggtaaacccggttccggttaacccgggggg

SEQ ID NO: 424837 - DNA, 688 bp, Homo sapiens
  misc_feature: GZ8MTXP02JF5HY.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcaggtgggtccgccgaggctccgaggcggaggggctgggaggtggggtggcgagggtgtgtctatttccagtggagaaatcgaaagtctacgggtgtacgtttccggtagacgggtccgtattccaacccgtatcctacccgagtaacgaacctaaattacccggaaagtaaaccacgagttacgttaccttacttaaccaaaagttacggaaacctacgaccctaggaacgtacccgtacgaacgggaaccgaccgggtacccgttaggtttaacgtttttgggtacggtaccggtaagtaaccgttacttaccgttacgttttaacccgtaaaagtttccgggtttacctacgtttaccggaacccggttcccggtaccgggggtaacccggg

SEQ ID NO: 424838 - DNA, 543 bp, Homo sapiens
  misc_feature: GZ8MTXP02I1LOE.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (367)..(367): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaattgtctcctggtatcaacatcatccaggtaaacgcccccaaatcatcatctatgaggcctataagaggccctcgtaggggtttctaatcgcttcacctcgcctccaacgtccgacaacnccggccctccctagacaactctctcgggacctccgaggctggacggacgaggctagtattattattgttgctcagtatgttcgtcgctatctacttatgttcgtaggaagtcgggactaaggtcaccgtctacggtcaagcccaacggcccaaccgtctcgtccacttccttcccg

SEQ ID NO: 424839 - DNA, 527 bp, Homo sapiens
  misc_feature: GZ8MTXP02JLKBX.44.27.C05.1.454.CMB.2.raw
  modified_base (188)..(188): a, c, t, g, unknown or other
  modified_base (222)..(222): a, c, t, g, unknown or other
  modified_base (283)..(283): a, c, t, g, unknown or other
  modified_base (364)..(364): a, c, t, g, unknown or other
  modified_base (417)..(417): a, c, t, g, unknown or other
  modified_base (421)..(421): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaacncccccaaatcatcatctatgagcctataagacggccctgagggtttctaaatcgcttcacctgcctcaacgtccgacaacncggcctcctagacaatctctggctccaggctgagacgagctgattatattgtncttnagatgttcgcgcatcactttatgttcgttacggaagtcgggtaaccaggtcaaccgtctacggtcacgtcccaaaggcccaaacccgactcgcctacgtcttcccg

SEQ ID NO: 424840 - DNA, 547 bp, Homo sapiens
  misc_feature: GZ8MTXP02GYR6N.44.27.C05.1.454.CMB.2.raw
  modified_base (385)..(385): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccaggcgaggggctgggagtggggtggcgagggtgtgtctatttccagtggaggaaatcgaaagttctacgggtnattccgttgaggggccattccacatctccagagacattccgagaacacagtgtactctacaaatgaacagcctagacgacctcgaggacacggccgtgttacgtttgtgcgagactatctgttacaaagttcgttactacttcgacgtccgtacgggtaccg

SEQ ID NO: 424841 - DNA, 508 bp, Homo sapiens
  misc_feature: GZ8MTXP02JJS1T.44.27.C05.1.454.CMB.2.raw
  modified_base (188)..(188): a, c, t, g, unknown or other
  modified_base (320)..(320): a, c, t, g, unknown or other
  modified_base (499)..(499): a, c, t, g, unknown or other
tcagacagtatatacacgaccggtgctcgatttagacgcgatcgaaggatttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaagcccccaaactcatcatctatgagcctataagaggcctnaggggtttctaatcgcttccactgcctcaagtccggcacacggcctccctgaccaatctctggctcagctgagacgaggctgattatattgttgctcagtattgttcgcgcaatcaactttatgtcttcggaagtcgggaccaaggtcaccgtctaggtcagcccaaggccaaaccccntcgtcactc

SEQ ID NO: 424842 - DNA, 514 bp, Homo sapiens
  misc_feature: GZ8MTXP02G808U.44.27.C05.1.454.CMB.2.raw
  modified_base (188)..(188): a, c, t, g, unknown or other
  modified_base (358)..(358): a, c, t, g, unknown or other
  modified_base (386)..(386): a, c, t, g, unknown or other
  modified_base (412)..(412): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctctgtatcaacatcatccagtaaacgccccaaatcatcatctatgagcctataagagccctcgagggtttctaaatcgcttcacctgcctcaagtccgacaacncgcctcctgacaatctctgggctcagcngagacgaggctgattatattgtgctnagtatgttcgtcgcatctacttatgtcttcggaaagttgggaaccctaaggtcaccgtctacgtcacgacccaaggcccaaacccactcgtcacctctcccg

SEQ ID NO: 424843 - DNA, 581 bp, Homo sapiens
  misc_feature: GZ8MTXP02HZZQJ.44.27.C05.1.454.CMB.2.raw
  modified_base (366)..(366): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccgaggcggaggggctgggagtggggtggcagggtgtgtcatttccagtggaggaaatnaagtctacgggtgatttccgttggagggtcccgatttccaccatctccagagaacaattccgagaaacacagtgtactcttacaaatgaaactagacctagacgacctacgacggaccacgggtccgtagttacgttttgtggacgtagacttactcgttacgtttaccaaaagttcggttactacgttaccggaccgtccgttacggggacccg

SEQ ID NO: 424844 - DNA, 598 bp, Homo sapiens
  misc_feature: GZ8MTXP02HQZ64.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccgccaggctccgaggcgaggggctggagtggggtgcgaggtgtgtcatttcagtggagaaatcaagtctacgggtgatttccgttgacgggcctatcacatctccagagacattcgagaacacagtgtctcttacaaatgaacagcctagacgaccgtcgaacggacgaccggtccgttacggtttacgtttttggtacggtacggtacggtaaccttacgtttccgttacgttttaaccgtaaaacgtttccgggtttactacgtttaccggtaccggtcccggttaccggggg

SEQ ID NO: 424845 - DNA, 528 bp, Homo sapiens
  misc_feature: GZ8MTXP02I73VC.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccaggcgaggggctgggagtggggtgcaggtgtgtcatttcatggaggaaatcaagtctacggtgattccgttgagggccgattcacatctcagagacattccgagaacacagtgtctcttacaaatagaacagcctgacacctcaggacacgccgtgtacttttgtcgcgagactatcttagttaaccaaagtcggttacattcgacgcgtacgggg

SEQ ID NO: 424846 - DNA, 528 bp, Homo sapiens
  misc_feature: GZ8MTXP02H1IZ3.44.27.C05.1.454.CMB.2.raw
  modified_base (188)..(188): a, c, t, g, unknown or other
  modified_base (222)..(222): a, c, t, g, unknown or other
  modified_base (320)..(320): a, c, t, g, unknown or other
  modified_base (362)..(362): a, c, t, g, unknown or other
  modified_base (378)..(378): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccagtaaagcccccaaatcatcatctatgaggcctataagaggccctnaggggtttctaaatcgcttcacctgcctcaagtccgacaacncgcctcctgacaatcnctgggctcagctggagacgagctgattattattgtgctcagtattgttcgtcgcatctacttattgttcgtggaagtcgggacctaaggtccaccgttactaggtcacgacccgaacggcccaaacccgactcgtacctacttcgtcccg

SEQ ID NO: 424847 - DNA, 495 bp, Homo sapiens
  misc_feature: GZ8MTXP02HSV4Z.44.27.C05.1.454.CMB.2.raw
  modified_base (187)..(187): a, c, t, g, unknown or other
  modified_base (221)..(221): a, c, t, g, unknown or other
  modified_base (319)..(319): a, c, t, g, unknown or other
  modified_base (332)..(332): a, c, t, g, unknown or other
  modified_base (354)..(354): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaagcccccaaatcatcatctatgagcctataagaggccctnagggttcaatcgnttcactgcctcaagtcgcaacncgcctcctgacatctctgggctcagctgagacgaggctgattatatgttgctcagtatgttcgcgcatcacttatgtctcggaagtggaccaaggtcacgtctaggtcagccaaggccaaacccgactgtccacttctccg

SEQ ID NO: 424848 - DNA, 571 bp, Homo sapiens
  misc_feature: GZ8MTXP02GL94Y.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccgaggcgaggggctgggagtgggtggcgaggtgtgtcatttcagtggagaaatcaaagttctacgggtgactttccgttgacggggtcccaatttccaacccatcctacccaagacgaactaattaccgaagaaacacagtcgtactctacaaatgaacagacctagacgacctacgacgacgacggccgtgtacttttgtgtcgagtacgtatactgtttaccaaaagttcggttactacgtcgtacgccgtacgggacccg

SEQ ID NO: 424849 - DNA, 592 bp, Homo sapiens
  misc_feature: GZ8MTXP02FKJKA.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccgccaggctccaggcgaggggctggagtggggtggcaggtgtgtcatttcagtggagaaatcaagtctacggtgattccgttgacggggccgtattcgacctattcaccagagacaacttccgaagaacacagtagtctcttacaaatgaacagccctgacgacctacgacggaccacgggacccgttaggtttagtttttggtgtccggtaagtaccgttaattcctttacgtttaaccctaaaagtttccggttactaacgtttccggaccggtccgttaccggggg

SEQ ID NO: 424850 - DNA, 550 bp, Homo sapiens
  misc_feature: GZ8MTXP02HII7D.44.27.C05.1.454.CMB.2.raw
  modified_base (267)..(267): a, c, t, g, unknown or other
  modified_base (282)..(282): a, c, t, g, unknown or other
  modified_base (362)..(362): a, c, t, g, unknown or other
  modified_base (377)..(377): a, c, t, g, unknown or other
tcagacagtatatacacgaccggtgctcgatttagacgcgatcgaagggtttgggggggtcacaagaggcagcgctctcgggacgtctccaccatggcctgggctctgctgccctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctgtatcaanatcatccaaggtaancccccaaatcatcatctatgaggcctataagacggccctgaggggtttctaatcgcttcactgcctcaagtccgacaacncgcctcctgacatcnctgggctcgagctgagacgagctagtattattatgttgctcagtatgttcgtcgctatctacttatcgttacgttacgggaagtcgggaccaaggttcccaccggttcctaacgggtccacggacccgaaacggaccccaaaccccctacgtacgtcctacttcgttaccccg

SEQ ID NO: 424851 - DNA, 556 bp, Homo sapiens
  misc_feature: GZ8MTXP02IVVWO.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcaggtggtccgcaggctcgaggcgaggggctgggagtggggtggcgaggtgtgtcatttccagtggagaaatcaaagttctcgggtgacttccgttgacggggccctaatttccaccatctccagacgaacaattccgaagaacacagtgtctcttacaaatagaacacgacctagagacctcaacggacacggccgtagttacgtttgtgtcgagtactacttcttgttactaaagttcgtactactcgacgtcgtacggaccg

SEQ ID NO: 424852 - DNA, 544 bp, Homo sapiens
  misc_feature: GZ8MTXP02JLC85.44.27.C05.1.454.CMB.2.raw
  modified_base (371)..(371): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataatggaatatgcagtggtccgcaggctccaggcgaggggctggagtggggtgcgaggtgtgtcatttcatggagaatcaagtctacggnattccgtgacggggccattcaccatcgtccagagacacttaccgagaacacagtgtctcttacaaatgaacagcctagacgacctcgaggaccgacggccgtacgttagttttgtcgacgtagtactatctgttaacaaaacttcggtactagttaccgacgtccgtacgggg

SEQ ID NO: 424853 - DNA, 487 bp, Homo sapiens
  misc_feature: GZ8MTXP02HNVSK.44.27.C05.1.454.CMB.2.raw
  modified_base (188)..(188): a, c, t, g, unknown or other
  modified_base (222)..(222): a, c, t, g, unknown or other
  modified_base (316)..(316): a, c, t, g, unknown or other
  modified_base (357)..(357): a, c, t, g, unknown or other
  modified_base (373)..(373): a, c, t, g, unknown or other
  modified_base (410)..(410): a, c, t, g, unknown or other
  modified_base (422)..(422): a, c, t, g, unknown or other
  modified_base (475)..(476): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctgtatcaacatcatccaggtaaacgccccaaatcatcatctatgagcctataagagccctnaggggtttctaatcgcttcacctgcctcaagtccgacaacncggcctcctgacatcntcggctcagctgaggacgagctgattatatgttgctnagtatgttcgtncatcattatgtcttcgaagtgaccaaggtcacgtcagtcagccaagccaaccnncgtcactctcc

SEQ ID NO: 424854 - DNA, 770 bp, Homo sapiens
  misc_feature: GZ8MTXP02HKDHG.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgatattggaatatgcagtgggtccgcaggctccgaggcgaggggctgggagtggggtggcagggtgtgtctatttccgagtgggaaggtaaatcgaaaggttcgtacggggttgtaacgtttcccggttaggaacgggggtccctaaagttttcccaacccgtatacccgttacccgaacggtaacgaacccgttaaaacgtttaccccggaaaggtaaaacccaaaccgtaacggttcggtttaccctttaccgttttaaaccaaaaacgtttacggaaaacctaacggtaccccgttacggaaccggtaacccttaccgaaacgggaacccgtaaccgggggtccccggtttaggtttaacgttttttgggtacggtaccggtaaaggttaaccttaacgttccgtttacgttttaaacccgtaaaaacgtttccgggtttacttacgtttacccggtacccggtacccggtttacgggggtaacccccgg

SEQ ID NO: 424855 - DNA, 506 bp, Homo sapiens
  misc_feature: GZ8MTXP02FG37N.44.27.C05.1.454.CMB.2.raw
  modified_base (222)..(222): a, c, t, g, unknown or other
  modified_base (364)..(364): a, c, t, g, unknown or other
  modified_base (419)..(419): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaaatatcttagtcttaaactttgtctcctggtatcaacatcatccaggtaaagcccccaaactcatcatctatgaggcctataagaggccctcaggggtttctaatcgcttcacctgcctcaagtccggcaacncgcctccctgacaatctctgggctcagctgagagaggctgattatattgttgctnagatgttcgtgcatcacttatgtctttcggaaagtggaccaaaggtcacgtctagtcagccaagccaacccactcgtcactctaccg

SEQ ID NO: 424856 - DNA, 521 bp, Homo sapiens
  misc_feature: GZ8MTXP02GVPLH.44.27.C05.1.454.CMB.2.raw
  modified_base (223)..(223): a, c, t, g, unknown or other
  modified_base (264)..(264): a, c, t, g, unknown or other
  modified_base (278)..(278): a, c, t, g, unknown or other
  modified_base (296)..(296): a, c, t, g, unknown or other
  modified_base (353)..(353): a, c, t, g, unknown or other
  modified_base (422)..(422): a, c, t, g, unknown or other
  modified_base (505)..(505): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaacttgtctctgtatcaanatcatccagtaacnccccaaatcatcatctangagcctataagagccctgagggtttcaatcgcttcacctgcctcaagtccgacaacnccgcctcctgactaactctcgtgggctcgaggctggacggacgaggctagtatttattagttgttgctnagtatgtttcgcgctatctacttatgttcgttaggagtcggacaggtccacgtctaggtacacgaccaacgcccaaacccctncgtacacttcgtcccg

SEQ ID NO: 424857 - DNA, 600 bp, Homo sapiens
  misc_feature: GZ8MTXP02H1T05.44.27.C05.1.454.CMB.2.raw
  modified_base (307)..(307): a, c, t, g, unknown or other
  modified_base (388)..(388): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctggagactctcctgtgcagcctctggattcaccttcgataattggaatatgcagtgggtccnccaggctccgagggcgaggggctgggagtggggtggcgagggtgtgtcatttcagtgggaggaaatcgaagtctacgggtnagttccgtgacggggcctatcacatctccagagacaacttccgaagaacacgagtgttctcttactaaatagaaacgacgaccgtacgacgtacctcgaacggaccgacggtccgttgttacgtttttggtacgtacggtagtacgttacttacgttacgtttaaccgtaaaacgttcggttactacgtttaccgaccggtccgtaccgggg

SEQ ID NO: 424858 - DNA, 549 bp, Homo sapiens
  misc_feature: GZ8MTXP02G0A18.44.27.C05.1.454.CMB.2.raw
  modified_base (285)..(285): a, c, t, g, unknown or other
  modified_base (365)..(365): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctcctggtatcaacatcatccaggtaaacncccccaaatcatcatctatgagcctataagacgccctcgtagggtttcaatcgcttcacctgcctcaagtccggacaacncggccctcctgaccaatctctcgggcctccgaggctggacggacgaggctgatttattattgttagcttcagtattgttcgtcgctatctactttatgttactttacgggaagtcgggaacctaagggtccaccgtcgtaggtccacgacccaaggccccaaccctactgtaccactcttcccg

SEQ ID NO: 424859 - DNA, 577 bp, Homo sapiens
  misc_feature: GZ8MTXP02JECAL.44.27.C05.1.454.CMB.2.raw
  modified_base (283)..(283): a, c, t, g, unknown or other
  modified_base (388)..(388): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtnattccgttgaggccgattcaccatctccagagacaattccgagaaacacagtgtctcttacaaatgaacagcctgagacctcaggacacggccgtgtatttttgngcgagactatctgtttaccaaaatcggttcattcgacgcctggggaccagggaaccctggtcacccgtctccctcggcctccaccaacgggccccagtccggtcccttcccccgtcgggccgtcccccgtgcccttcccgaacggacgccaacccgtcccggaacgacggcaccgacggccggccccgg

SEQ ID NO: 424860 - DNA, 503 bp, Homo sapiens
  misc_feature: GZ8MTXP02IU4NU.44.27.C05.1.454.CMB.2.raw
  modified_base (269)..(269): a, c, t, g, unknown or other
  modified_base (283)..(283): a, c, t, g, unknown or other
  modified_base (359)..(359): a, c, t, g, unknown or other
  modified_base (375)..(375): a, c, t, g, unknown or other
  modified_base (491)..(491): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaaatattcttagtcttaactttgtctcctggtatcaacntcatccaggtaaancccccaaatcatcatctatgaggcctataagaggccctgagggtttcaatcgcttcactgcctcaagtccgcaacncggcctcctgacatcnctggctcagctgaggacgagctgatttatattgttgctcagatgttcgtcgcatcacttatgtcttcggaagttcgggacaaggtcaccgtctaggtcagcccaaggcccaacccnctgtcactctcg

SEQ ID NO: 424861 - DNA, 500 bp, Homo sapiens
  misc_feature: GZ8MTXP02JK9O2.44.27.C05.1.454.CMB.2.raw
  modified_base (281)..(281): a, c, t, g, unknown or other
  modified_base (319)..(319): a, c, t, g, unknown or other
  modified_base (414)..(414): a, c, t, g, unknown or other
  modified_base (491)..(491): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgtgcccagtctgccctgactcagcctgcctccgtgtctgggtcgcctggacagtcggtcaccatctcctgcactggagccagcggtaatattcttagtcttaactttgtctcctggtatcaacatcatccaggtaaancccccaaatcatcatctatgaggcctataagagccctnaggggtttctaatcgcttccactgcctcaagtccgcacacggcctccctgacaatctctggctcagctgaggacaggctagattattattgttgntcagtatgttcgtcgcatcacttatgtcttcggaagtgggaccaaggtcaccgtctaggtcagccaaggccaacccntcgtcactc

SEQ ID NO: 424862 - DNA, 562 bp, Homo sapiens
  misc_feature: GZ8MTXP02JQBCA.44.27.C05.1.454.CMB.2.raw
  modified_base (375)..(375): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccaggcgagggctggagtgggtggcaggtgtgtcatttccgatgggagaaatcgaaagttctcgggtnagttcccgttgagggccgattcaccatctccagagacaattccgaagaacacagtgtactcttacaaatgaacagcctagacgacctcgaggaccacggccgtgttacgttttggagtccggagtaccgttatcgttacgtttaccaaaagttcggtactacgttcgaccgtccgtcggggtacccg

SEQ ID NO: 424863 - DNA, 711 bp, Homo sapiens
  misc_feature: GZ8MTXP02H27YG.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggatcaccttcgataatggaatatgcagtggtccgcaggcctccgaggcggaggggctgggaggtggggtggcgagggtgtgtcatttccgagtgggaggaaatcgaaaggttctacgggtgtaacgttcccggttaggacggggtccgtattcccaaccctacgtcctacccgaaggaacgtaacctaaacgttacccggaaacgaaaccaaccgtagttacgtaccttactttaaccaaaagttacgaaacacggaccctaggaaccgtaaccctcgaacgggaaccgaccggggtacccggttaggtttacgttttcgggtacggtaccggtaacggtacttacgttacgtttacggtttaaacccgtaaaaacgtttccggttaaccgttaaccgtttacccgggtacccggtacccgggttacgggggtaacccccgggg

SEQ ID NO: 424864 - DNA, 535 bp, Homo sapiens
  misc_feature: GZ8MTXP02I4F5L.44.27.C05.1.454.CMB.2.raw
  modified_base (242)..(242): a, c, t, g, unknown or other
  modified_base (406)..(406): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcccccgtgtctggttctcctggacagtcgatcaccatctcctgcactgggtccagcaatgacattggganatataaccttgtctcctggtatcaacaacatccaggcaaacgccccaaactcatacttttgagtccagtgagcggccgtcaggttgtttctaatcgtcttcctctgctcaagtctcgccacacggcctccctgtcgatctctcgggcctccggcctgaggacgnggctgactatacgtgcgtctctattacaacttctagagtacgttgggtgttcggcgggtaggctccgaccgtgaccgtccgtacggtcacgcccaaggcctcgccccctggccacctctcgttaccccc

SEQ ID NO: 424865 - DNA, 548 bp, Homo sapiens
  misc_feature: GZ8MTXP02I0DBZ.44.27.C05.1.454.CMB.2.raw
  modified_base (302)..(302): a, c, t, g, unknown or other
  modified_base (401)..(401): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccncaggctccaggcgaggggctggagtgggtggcaggtgtgtcatttcagtggaggaaatcaagttctacgggtgattccgtgaggggccgtattccaccntctcagagacaattccgagaacacagtgtctcttacaaatgaacagacctagacgacctcgacggacacggccgtgttacttttgtgtcgagtactatcttgtttacctaaagttcggttactactacgacgtccgtcggggacccg

SEQ ID NO: 424866 - DNA, 544 bp, Homo sapiens
  misc_feature: GZ8MTXP02FQ0DA.44.27.C05.1.454.CMB.2.raw
  modified_base (264)..(264): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctntggattcaccttcgataattggaatatgcagtgggtccgccaggctccgaggcgaggggctgggagtggggtggcgaggtgtgtcatttccagtggagaaatcaagtctacggtgattccgttgagggccattcaccatctcagagacaatccgaagaacacagtgtctcttacaaatacgaacagacctagacgacctacacggacacggccgtgttattttgtgcgagactatctgtttacaaaacgttcggttactattcgacgccgtcgggacccg

SEQ ID NO: 424867 - DNA, 547 bp, Homo sapiens
  misc_feature: GZ8MTXP02INM9A.44.27.C05.1.454.CMB.2.raw
  modified_base (264)..(264): a, c, t, g, unknown or other
  modified_base (306)..(306): a, c, t, g, unknown or other
  modified_base (312)..(312): a, c, t, g, unknown or other
  modified_base (351)..(351): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctgtatcaacntcatcagtaagcccccaaatcatcatctatgagcctataagngccctnagggtttctaatcgcttcacctgcctcaagtccgcaacncggcctccctgacatctctgggctcaggctgaggacgaggctgatttatattgttgcttcagtattgttcgtcgctatctactttatgttacgttcggaaagttcggggaacctaaaggtccaaccgttccgtagggttaccaacgaccccgaaaggacccccaaaccccgacttcgtacctaccgttacttcccg

SEQ ID NO: 424868 - DNA, 535 bp, Homo sapiens
  misc_feature: GZ8MTXP02I7NM7.44.27.C05.1.454.CMB.2.raw
  modified_base (455)..(455): a, c, t, g, unknown or other
  modified_base (482)..(482): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgccagggctccaggcgaggggctgggagtggggtggcaggtgtgtcatttcatggagaaatcaagtctacggtgattccgttgagggccgattcaccatctccagagacaattccgaagaacacagtgtctacttcaaatgaacagcctganacctcaggacacggccgtgtattttgngacgagtactactcttagtttaaccaaaatcggttacattcgacgcgtcgggg

SEQ ID NO: 424869 - DNA, 628 bp, Homo sapiens
  misc_feature: GZ8MTXP02G4GRC.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccncaggctccgaggcgaggggctggagtgggtggcaggtgtgtcatttccagtggaggaaatcgaaagtctacgggtgattccggttgacggggccgtattccgacctatcctaccagagactaactccgaagaacacgagtgtactacttacaaatagaaacacgacctagaacgaccctacgaacggaccgaccgggtccgttagtttaacgtttttggtacggtacggtaacggtaaccgttattaccgtttacgttttaaccgtaaaacgtttccggtttaactacgttaccggtaaccggtccggttacggggtaaccccgg

SEQ ID NO: 424870 - DNA, 620 bp, Homo sapiens
  misc_feature: GZ8MTXP02HJXFF.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccgccaggctccaggcgaggggctgggagtggggtggcagggtgtgtcatttccagtggaggaaatcaaagttctacgggtgattccgttgacggggtccattccacatctccagagacaattaccgagaacacagtgtctacttacaaatagaaacacgacctaggacgacctcgaacggaccgaaccgggtccgttacgttacgtttttggtggtaccggtaaggtaaccttagtacctttacggtttaacctaaaaagttccgggtttacctacgttaccggtaaccgtcccggttacgggggtaaccccggg

SEQ ID NO: 424871 - DNA, 509 bp, Homo sapiens
  misc_feature: GZ8MTXP02F5G94.44.27.C05.1.454.CMB.2.raw
  modified_base (188)..(188): a, c, t, g, unknown or other
  modified_base (360)..(360): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccagtaaagcccccaaatcatcatctatgaggcctataagaggccctcaggggtttctaatcgcttcacctgcctcaagtccggcaacncggcctcctgacaatctctgggctcaggctgaggacgaggctgattattatgttgctcagtattgtcgtcgcatcacttatgtcttggagtcggacaaggtcacgtcctaggtcagacccaaggcccaacccactcgtcactcttcccg

SEQ ID NO: 424872 - DNA, 603 bp, Homo sapiens
  misc_feature: GZ8MTXP02G5LT6.44.27.C05.1.454.CMB.2.raw
  modified_base (546)..(546): a, c, t, g, unknown or other
  modified_base (565)..(565): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcagtagctactggatgcactgggtccgccaagctccgaggggaaggggctgggtgtgggtctcgacgtaattaagtaggtgagtggggaagtagacacgaagcgtacggccggactcccggtaggaaacggggcccgaattcccgaacctagttccctacccgaaggaacgaaacccaacgacccaaaagaaacctacggctagtaactcctagaactaaatacgaaacagtctagagaacgccgaagacgacggctgtagtattacngtacgacgaaggcgccggnggacggggtaggttcggggagtttcgactacgtaaccg

SEQ ID NO: 424873 - DNA, 698 bp, Homo sapiens
  misc_feature: GZ8MTXP02JWW61.44.27.C05.1.454.CMB.2.raw
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtgggtccncaggcctccgaggcgagaggcgtgggaggtgggtggcagggtgtgtcatttcagtgggaaggaaaatcgaaagttcgtacgggtgtacgtttccggttgacggggtccctattccacccgtaatcctaccgaagacgaacaacttaccgaaacgaaaccaccgtaaggttacgttaccttacctttaccaaaaagttacgaaaccgtaacgtacccgtacggaaccggtaaccctaccgaacgggaaccgtaaccggggtcccgtttaggtttaacgtttttggtacggtaccggtaaagtaaccgtttacttacgtttacggttttaaacccgtaaaaacgtttccgggtttacctaacgtttacccggtaaccggtccggttaacccggggg

SEQ ID NO: 424874 - DNA, 569 bp, Homo sapiens
  misc_feature: GZ8MTXP02G5S5D.44.27.C05.1.454.CMB.2.raw
  modified_base (505)..(505): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccgcaggctccaggcgaggggctgggagtggggtggcgaggtgtgtctatttccagtggaggaaatcgaagtctacgggtgactttccggtgacggggtccatttccaccctatcctaccagacgaacaattaccgagaacacagtgtctcttacaaatgaacagacctgacgacctcgacggacgacggccgtcgttagtttgngcgtagactactcgttacttacaaagttcggttactacgttccgacgtccgtacgggtacccgg

SEQ ID NO: 424875 - DNA, 530 bp, Homo sapiens
  misc_feature: GZ8MTXP02H7LO9.44.27.C05.1.454.CMB.2.raw
  modified_base (222)..(222): a, c, t, g, unknown or other
  modified_base (267)..(267): a, c, t, g, unknown or other
  modified_base (320)..(320): a, c, t, g, unknown or other
  modified_base (360)..(360): a, c, t, g, unknown or other
  modified_base (369)..(369): a, c, t, g, unknown or other
  modified_base (378)..(378): a, c, t, g, unknown or other
  modified_base (513)..(513): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctcctggtatcaacntcatccaggtaaagcccccaaactcatcatctatgagcctataagaggccctnaggggtttctaaatcgcttcacctgcctcagtccgcaacncggctcccngacatctcngggctcaggctggaggacgaggctgatttattattgttgcttcagtatgttccgtcgcatctacttatgttcttaggagttcgggaccaaaggtcaacccgtctagggtccagtcccaaagggtcccaaaccccntcgtccacctcttcccg

SEQ ID NO: 424876 - DNA, 639 bp, Homo sapiens
  misc_feature: GZ8MTXP02IKGSN.44.27.C05.1.454.CMB.2.raw
tcagacagtatatacacgaccggtgctcgatttagacgcgatcgaagggtttgggctgagcgtgggtttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaatcagtctaggtgatcgtgaggccgatcacatctcagagacaattccgagaaacacagtgtctcttacaaatcgaaacagctgagacctcagggacacgggtcccgttagttacgtttttggagcggtaagtactaagttctagtttacctaaaagttcggtttactagttcgtacgaccgtcgggggaccgaacggggtaacccgttacggtaccgtacccggttcctcccgttccgggccttaccccgaaccgtaaacgggcccctaacgtcccggttcccgtttcccccctcgggtcccgccccgtttcggcccttcccgaacggggtccgaccaaccgtcccgagacggaccacgaccggcgcccgg

SEQ ID NO: 424877 - DNA, 551 bp, Homo sapiens
  misc_feature: GZ8MTXP02G8RR6.44.27.C05.1.454.CMB.2.raw
  modified_base (189)..(189): a, c, t, g, unknown or other
  modified_base (280)..(280): a, c, t, g, unknown or other
  modified_base (359)..(359): a, c, t, g, unknown or other
  modified_base (368)..(368): a, c, t, g, unknown or other
  modified_base (423)..(423): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctctgtatcaacatcatccagtaaacncccccaaatcatcatctatgagcctataagagccctcgagggtttctaatcgcttcacctgcctcaagtccggacaacncggcctccngacaatctctcgggcctccaggctggacggacgagctgtattattattgttgctnagtatgttcgtcgctatctacttatgttacgtttggaaaggtcgggaaaccctagggtacacccgttacgtacggtacacggaccccaaggaccccaaacccacgtcgtacctactcccgtttacccg

SEQ ID NO: 424878 - DNA, 779 bp, Homo sapiens
  misc_feature: GZ8MTXP02FY8QX.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccgcaggctccgaggcgaggggctggagtgggtggcgaggtgtgtcatttccagtgggaagtaaatcgaaaggttctacggggtgtaacgtttcccgggttagggacggggtacccgtaatttcccgaaacccgtacttcccgtacccgaaagggtaacgtaaaccgtaaacgtttaccccggaaaggaaaccctaaccgtaggttacgttacccgttacctttaaacctaaaacgttacggaaaaccgtaacgggtaccccgtttaacgggaaccggtaaaccccgttacggtaaacggggaacccgtaaccggggtaccccggtttaggttttaaacgttttttcggggtacggttacccggtaagggttaaccttaacgtttaccgtttaacggttttaacccgtaaaaacgtttccgggtttaacctaacggttttacccggaacccggtcccggtttaccgggggtaaccccggg

SEQ ID NO: 424879 - DNA, 545 bp, Homo sapiens
  misc_feature: GZ8MTXP02H2DS5.44.27.C05.1.454.CMB.2.raw
  modified_base (266)..(266): a, c, t, g, unknown or other
  modified_base (306)..(306): a, c, t, g, unknown or other
  modified_base (350)..(350): a, c, t, g, unknown or other
  modified_base (382)..(382): a, c, t, g, unknown or other
  modified_base (427)..(427): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagccctntggattcaccttcgataattggaatatgcaggtgggtccnccaggcctccgaggcgaggggctgggagtcggggtgcgaggtgngtcatttcagtggaggaaatcaagtctaggtnattccgtgagggctaatcaccatctcagagacaactcgagaacanagtagtctcttacaaatagaacagcctagacgaccacacgacgacgtccgtgttatttttggcgtagacgtactattctagttaaccaaaattcggtctaagttcgacgtcgccgggg

SEQ ID NO: 424880 - DNA, 536 bp, Homo sapiens
  misc_feature: GZ8MTXP02JJ6HJ.44.27.C05.1.454.CMB.2.raw
  modified_base (188)..(188): a, c, t, g, unknown or other
  modified_base (222)..(222): a, c, t, g, unknown or other
  modified_base (234)..(234): a, c, t, g, unknown or other
  modified_base (364)..(364): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccaggtaaacgccccaaactcatcatctatgaggcctataagaggccctgaggggtttctaatcgcttcacctgcctcaacgtccggacaacncggcctcctgacatctctcgggctcagctgaggacgagctgattattatgttagctcagtatgttcgtacgctatcacttatgttcgtacggaagtcgggaccaaggtccaccgttccgtacgtcgacgacccgaacgacccgaacccctactcgtacctacctctttcccg

SEQ ID NO: 424881 - DNA, 577 bp, Homo sapiens
  misc_feature: GZ8MTXP02JZWLT.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccgcaggctccgaggcgaggggctgggagtggggtggcgaggtgtgtcatttccagtggagaaatcgaagttctacgggtgagtttccggttgacggggccgtattccaccgtatctcccgaagacgaacaacgttaccgaagaaacactagtgtctcttacaatagaacagacctagacgacctcgacggacgacggtccgtgttatttgtcgacgtagtactactcttacgttaccaaaagttcgtactacgttccgacgtaccgtcggggacccg

SEQ ID NO: 424882 - DNA, 584 bp, Homo sapiens
  misc_feature: GZ8MTXP02GDYPU.44.27.C05.1.454.CMB.2.raw
  modified_base (488)..(488): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctctggtatcaacatcatccaaggtaaacgcccccaaactcatcatctatgatgacctataagacggccctcgtaggggtttctaatcgtcttccactgccctaccaacgtcccggacaccgaccgccctccctagaccaatctcgtcgggcctccgaggctggaacggacgaggtctagtaatttattagtttgttgcttacagtattcggttcgcgtctacttctaactttntcgttcgttacggaagttcgggaacctaacggtccaccgttcgtacggtaccgacgaacccgaaacggacccaaccccgactctaccactttcccg

SEQ ID NO: 424883 - DNA, 557 bp, Homo sapiens
  misc_feature: GZ8MTXP02JMGN9.44.27.C05.1.454.CMB.2.raw
  modified_base (395)..(395): a, c, t, g, unknown or other
  modified_base (468)..(468): a, c, t, g, unknown or other
  modified_base (549)..(549): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttacaaatcgaacagcctagacgacctcaggacacggccgttagttatttttgngcgagactaatctgtttacctaaaagtcgttacattcgacgccgtgggccgagggaaccctggtccaccgtcncctcgcctaccaccaacggcccacgtccgtccttccccgtgccgccctcgcctccgacgcgccaacctccgacgacgcacncgcgcccg

SEQ ID NO: 424884 - DNA, 509 bp, Homo sapiens
  misc_feature: GZ8MTXP02G7YVE.44.27.C05.1.454.CMB.2.raw
  modified_base (187)..(187): a, c, t, g, unknown or other
  modified_base (280)..(280): a, c, t, g, unknown or other
  modified_base (316)..(316): a, c, t, g, unknown or other
  modified_base (356)..(356): a, c, t, g, unknown or other
  modified_base (415)..(415): a, c, t, g, unknown or other
  modified_base (438)..(438): a, c, t, g, unknown or other
  modified_base (496)..(496): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccagtaaanccccaaatcatcatctatgagcctataagagccctnaggggtttcaaatcgcttcacctgcctcaagtccgcaacncgcctccctgacaatctctgggctccaggctgaggcgaggctgattattattgttgctnagtatgttcgcgcatcactttangtcttcggaagtcgggaaccaaggtcaccgtctaggtcagcccaaaggcccaaacccntcgtcactctccg

SEQ ID NO: 424885 - DNA, 580 bp, Homo sapiens
  misc_feature: GZ8MTXP02H7SFG.44.27.C05.1.454.CMB.2.raw
  modified_base (410)..(410): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataatggaatatgcagtggtccgcaggctccgaggcgaggggctgggaggtggggtggcgagggtgtggtctatttccagtggaaggaaatcgaaagttctacgggtgtattccgtgagggccgattccacanctccagagacaattaccgagaacacagtcgtactcttacaaatagaaacacgacctagacgacctacgacggaccgacggccgtagttacgttttgtcgacgtacgactataccttagtttacccaaaagttcggttactacgttaccgaccggccgttacggggacccg

SEQ ID NO: 424886 - DNA, 547 bp, Homo sapiens
  misc_feature: GZ8MTXP02GKGVI.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctctggattcaccttcgataattggaatatgcagtgggtccgcaggctccgaggcgaggggctgggagtggggtggcgagggtgtgtctatttccagtggaggaaatcgaagttctacgggtgattccggttgagggccattcaccatctcagagacaatccgagaacacagtgtctcttacaaatagaacagcctacgacgacctcgacgaccgacggtccgtgttactttgtgcgtagactatctgtttaccaaaagttcgtactacttcgacgccgtacgggaccgg

SEQ ID NO: 424887 - DNA, 598 bp, Homo sapiens
  misc_feature: GZ8MTXP02HBSJ1.44.27.C05.1.454.CMB.2.raw
  modified_base (306)..(306): a, c, t, g, unknown or other
  modified_base (337)..(337): a, c, t, g, unknown or other
tcagacagtatatacacgaccggtgctcgatttagacgcgatcgaagggtttggggagccctgggagacgagcccagcactggaagtcgccggtgtttccactcggtgatcatcattgaacacagaggactcaccatggagtttgggctgagctgggttttcctcgttgccctcttaagaggtgtcatgtgtcaggtgcaattcgtggagtctgggggaggcgtggccccgaggtaggggggtccctggagactctcctgtgcagcctctggattcaccttcgataatggaatatgcagtggtccncaggctccgaggcgaggggctgggagtgggnggcaggtgtgtcagtttcagtggaaggtaaatcgaagtccgtacgggtgacgttccggttggacgggcccgtattccacctatcctaccagacgacaacttaccgaagaacacagtgtactacttacaaatagaacagcctagacgacctacgacggacgacggtccgttacggttagttttggtcggtacgtaagtactacttcgttacgttaacctaaaacgttcggttactacgttaccgaccgtccggtaccggggg

SEQ ID NO: 424888 - DNA, 546 bp, Homo sapiens
  misc_feature: GZ8MTXP02IXERE.44.27.C05.1.454.CMB.2.raw
  modified_base (300)..(300): a, c, t, g, unknown or other
  modified_base (377)..(377): a, c, t, g, unknown or other
  modified_base (421)..(421): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccnccaggctccaggcgaggggctgggagtggggtggcagggtgtgtcatttccagtggaggaaatcaagtctacgggtnattccgttgagggccgattcaccatctccagagacaattccganaacacagtgtctcttacaaatgaacagcctagagacctcgacggacacggccgtagttacttttgtgcgagacttatacttgtttaccaaaagtcggttacacttcgacgccgtacggggacccg

SEQ ID NO: 424889 - DNA, 643 bp, Homo sapiens
  misc_feature: GZ8MTXP02GF8BZ.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataaattggaatatgcagtggtccgccaggctccaggcgaggggctggagtgggtggcaggtgtgtcatttctagtagaaggaaatacaagtacgtacggtagtagttacgttaggacgggacgtacgttacaccactctaccaacgaacgaactaaactaccgaacgaaacaacaacgtacgtaccttacttaactaaaactaagaaacgaacgaccgtacgacgaccgtacgaacggaacgaaccggtaccgttacgttacgttttagtttacggtacgtaacgtaacgttaacttacgttacgtttaaaccgttaaaacgttaacgttacgttacgttacgtaccgtaccggtacgggtaccgg

SEQ ID NO: 424890 - DNA, 655 bp, Homo sapiens
  misc_feature: GZ8MTXP02FMVJZ.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccgccaggctccgaggcgaggggctgggagtggggtggcgagggtgtgtcatttccagtggagaaatcgaaagttctacgggtgacgtttccggttaggacggggtcccgtaatttccgaaccctattccttacccgaagaacgaacctaaacgttacccggaacgaaaccgacgacgtcgttaccttacctttacaaactacgaaacacgaccctagaacgtacccgtacgaacgggaccgaccgggtcccgttgtttaacgtttttggtcggtacgtacggtacttacttaccttacgtttaacctaaaagttccggttactacgttaccggaccggtccgtacggggacccgg

SEQ ID NO: 424891 - DNA, 712 bp, Homo sapiens
  misc_feature: GZ8MTXP02F7NPH.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcacttcgataattggaatatgcagtggtccgccaggctccgaggcgaggggctggaggtggggtggcgagggtgtgtctatttccgagtgggaggtaaatcgaaaggttctacggggtgtacgtttcccggttaggacggggtcccgtatttaccgaccctaattcccgttacccgaacgaacgtaaccgtaaacgtttaccccggaaagtaaaccgacgaacggttcgttaccttaccgtttacaaaattcgaaaactacggtccctaagaccgacccgttacgaacggacccgaccgggtccgttacgtttacgtttttaggtacggaccggttaacggtacttacgtttaccgtttacggttttaaccctaaaaaggtttcccgggtttaacttaccgtttaccggtaacccggtcccgggtttacgggggaacccccgg

SEQ ID NO: 424892 - DNA, 598 bp, Homo sapiens
  misc_feature: GZ8MTXP02IJ6I9.44.27.C05.1.454.CMB.2.raw
  modified_base (305)..(305): a, c, t, g, unknown or other
  modified_base (381)..(381): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccnccaggctccgaggcgaggggctgggagtggggtggcaggtgtgtcatttccatggaggaaatcaagtctacgggtntattccggttgacggggccgtaatttccgacctatcctaccagaacgacaaattccgaagaaacacgagtgtctcttacaaattgaacagacctagacgacctacgacggaccacggtaccgtagtttagttttcggtgtaccgtaagtacttacttcgttacgtttacctaaaagttcggttactacgttacgtaccgtccgttacggggacccgg

SEQ ID NO: 424893 - DNA, 740 bp, Homo sapiens
  misc_feature: GZ8MTXP02HP9ZS.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagcgtggttttcctcgttgcctcttaagaggtgtcatgtgtcaggtgcaattcgtggagtcgtgggggaggcgtcggccccgaggtacgggggtccctggagactctccgtgtgcagcctcgtggacttcaccttcgataattggaatatgcaggtggtacccgccaggctccgaggcggaggggcgtgggaggtggggtggcgtagggtgtggtctatttccgagtggaagtaaactcgaaagttcgtacgggttgtaacgtttcccggttaggacgggggtcccgtaaagttcccgaaccctagttacccttaccgaacggaacgtaacccgtaaacgtttaccccggaaagaaaccgtaaccgtagttacgttaccgttaccttaacaaaagttacgaaccgtaacggtaccttacggaacgtaacccgtcgaaacgggaccgtaccgggtaccgtttaggtttacgtttttggtacggtacgtaacggttaacctttacgttaccgtttacggtttaaaccgtaaaacgtttcccggttaacttacgttaccggtaacccggttcccgggtacggggtaaccccggg

SEQ ID NO: 424894 - DNA, 599 bp, Homo sapiens
  misc_feature: GZ8MTXP02JNP0H.44.27.C05.1.454.CMB.2.raw
  modified_base (391)..(391): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcaggtgggtccgccagggctccgaggcggaggggctggggaggtggggtggcgagggtgtgtctatttccagtgggaagtaaatcaaagttcgtacgggtntaacgtttccggttagacgggtccgtattaccgaccactcctaccagacgacaattaccgagaacgaacagtagttctacttacaaactagaacacgactacgacgacctacgacggacgacggtacgtcgttacgtttggtgtcgagtacttactcgttacgttacctaaaagttcggttactacgttcgaccgccgtcgggaccgg

SEQ ID NO: 424895 - DNA, 564 bp, Homo sapiens
  misc_feature: GZ8MTXP02F36BW.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcaggtggtccgccaggctccgaggcgaggggctgggagtgggtggcagggtgtgtcatttccagtgggaaggaaatcgaaagttcgtacgggtgaacgtttccggttgaggggtcccgaatttccaccctatctccagagacaattccgagaacacagtgtctctacaatagaacagctacgacgacctcgaggacacggccgtagttacttttgtgcgagtactatctgtttacctaaagtcggttactacttcgacgtccgtacgggaccg

SEQ ID NO: 424896 - DNA, 591 bp, Homo sapiens
  misc_feature: GZ8MTXP02GCZFW.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (365)..(365): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaactttgtctctggtatcaacatcatccagtaacgcccccaaactcatcatctatgagcctataagacggccctcgaggggtttctaatcgctttcacctgcctcaagtccggacaacncggcctccctgacaatctctgggctccgaggctgaggacgagctgatttattattgttagctcagtattgttcggtcacacttctaactttagtgttaccgtttacgggaagttacgggggtaacccaaggggtttcccaaacccggttcccgttaggggaccctaagtttcggttaaccgacttacgaaaagggtaaaacttcggaaaccgtagggtaaaggggg

SEQ ID NO: 424897 - DNA, 508 bp, Homo sapiens
  misc_feature: GZ8MTXP02F4F8V.44.27.C05.1.454.CMB.2.raw
  modified_base (362)..(362): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcacctgcctcaagtccggcaacncggcctcctgacaatctctgggctccaggctgaggacgagctgattattatgttgctcagatgttcgtgcatcacttatgtcttcggaagtgggaccaaggtcaccgtctaggtcagcccaaggccaacccactcgtcactctccg

SEQ ID NO: 424898 - DNA, 596 bp, Homo sapiens
  misc_feature: GZ8MTXP02G34MW.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtcgggtccncaggctccgaggcgaggggctgggagtggggtggcgagggtgtgtcatttccagtggaggaaatcgaagtctacgggtgattccggttgaggggtccgtattccaccatctccagacgacaatccgaagaacacagtcgtctcttacaatagaacacgacctagacgaccgtacgacggacaccggtcgtacgtttacgttttaggtgtacggagtacctagttcgttacgtttacctaaaacgttcggtttacctacgttaccgaaccggtcccggtacgggggtaacccgg

SEQ ID NO: 424899 - DNA, 585 bp, Homo sapiens
  misc_feature: GZ8MTXP02I43FQ.44.27.C05.1.454.CMB.2.raw
  modified_base (304)..(304): a, c, t, g, unknown or other
  modified_base (378)..(378): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcaggtcggtccncaggctccgaggcgaggggctgggagtgggtggcaggtgtgtctattccagtggagaaatcaagttctagggtnattccgttgacgggcctattccaccatcctacagagacaacttccgaagaacacagtgtctctacaatagaacacgcctagacgacctacgacggaccgacggtccgttagttacgttttgtgtacgtaacgtacttacttccgtttacgtttaacctaaaacgttcggttactacgttaccgaccggtccggtacggggtacccgg

SEQ ID NO: 424900 - DNA, 726 bp, Homo sapiens
  misc_feature: GZ8MTXP02H2TVS.44.27.C05.1.454.CMB.2.raw
  modified_base (281)..(281): a, c, t, g, unknown or other
  modified_base (364)..(364): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctgtatcaacatcatccaggtaaacncccccaaatcatcatctatgacgtactataagcgccctgtagggtttcaagtcgctcactcgcctacaacgtcccgacaaccnccggtcctaccctcgaacctaactcctcgtcggggccctaccgacggtccgtaggaacgggacggtaggtccttaggttaactttaagtttagtttggtttacgtaccttaccgtaaaggtttacgtttcgggtttccggttccgacttaacttacgtttaacctttaagtttcggtttccgtttaaacggggtaaagggtttacccggggaaaaccgttaaaacggggttcccctaaacccgggttaccgtttaaccggggtacccaaacccgggaacccccgtaaaaccggggacccccctaaaaaccccccgtacgtttaccggtaacccccgttaacctttcccggtttcccccccgg

SEQ ID NO: 424901 - DNA, 600 bp, Homo sapiens
  misc_feature: GZ8MTXP02HS3OP.44.27.C05.1.454.CMB.2.raw
  modified_base (334)..(334): a, c, t, g, unknown or other
  modified_base (336)..(336): a, c, t, g, unknown or other
tcagacagtatatacacgaccggtgctcgatttagacgcgatcgaagggtttggggcctgggagacgagcccagcactggaagtcgcctgtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgccaggctccgaggcgaggggctggagtggggngnaggtgtgtcatttcagtggaaggaatcaagtcgtacggtgtattccgttgacgggtccgattcgaccacgtctccgagtagacaacttaccgaagaacacagtgtcttcttacaaatagaacagcctacgacgacctacgacggacgaacggtcccgttaggttacgtttttggtggtacgtaacggtaccgttaattccgttacgtttaacctaaaaacgttccggtttactacgtttaccggtaaccgtaccgttccggggg

SEQ ID NO: 424902 - DNA, 716 bp, Homo sapiens
  misc_feature: GZ8MTXP02JW8OI.44.27.C05.1.454.CMB.2.raw
tcagacagtatatacacgaccggtgctcgatttagacgcgatcgaagggtttgggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgccaggctccgaggcgaggggctgggagtgggtggcagggtgtgtcatttcgagtggaggaaatcgaaagttctacggggtgacgtttccgttagacggggtcccgtaatttcccaacccgtaacttccttacccgaacgtaacggaacctaaacgttacccggaaagtaaaccgaacgtaacgttacggttaccttaccgtttaaccaaaagttacggaaaacctaacggtacccgttacgaacggtaacccgtaccgaaacgggacccgaaccgggtaccccggttagtttaacgtttttggttcggtaccgggtaacgttaaccgttagttaccgtttacgttttaacccgtaaaaacgttccgggtttactaacgtttaccggtacccggtcccggttacgggggtaccccgg

SEQ ID NO: 424903 - DNA, 558 bp, Homo sapiens
  misc_feature: GZ8MTXP02I65EM.44.27.C05.1.454.CMB.2.raw
  modified_base (371)..(371): a, c, t, g, unknown or other
  modified_base (488)..(488): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcagtggtccgcaggctccaggcgaggggctgggagtggggtggcagggtgtgtcatttcatggagaatcaagtctcgggtnattccggtgacggggcattccaccatctccagagacaattccgaagaacacagtgtctcttacaaattgaacaggaccctagacgacctacgaggacaccggccgtgttagttttgngtcgtaagtacttactcttgtttaccaaaagttccggttactacttcgaccgtccgtacggggtacccgg

SEQ ID NO: 424904 - DNA, 721 bp, Homo sapiens
  misc_feature: GZ8MTXP02I84K1.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataattggaatatgcaggtggtccgccaggctccgaggcgaggggctgggagtggggtggcgaggtgtgtcatttccagtggaagaaatcgaaagttcgtacggggtgtaacgtttcccggttagacgggggtcccgtaatttcccaacccgtaacttcccgtacccgaaacggtaacggaaacctaaacgttaccccggaaacgaaaacccaaccgtaaggttcggttaccttaccctttaacaaaacttacgaaaacctacgggtacccttaggaaccgtaacccgttacgaacgggtaaccgaaccggggtccccggtttaggtttacgtttttaggtcggtccggtaaaggtacccttaacttccgtttacgtttaacctaaaacgtttccggtttactaacgtttccggaacccggtaccggttccgggggtaaccccgg

SEQ ID NO: 424905 - DNA, 705 bp, Homo sapiens
  misc_feature: GZ8MTXP02HZ330.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccaggtaggggggtccctgagactctcctgtgcagcctctggattcaccttcgataattggaatatgcaggtcgggtccgccaggcctccgaggcgaggggctgggagtggggtggcgagggtgtgtctatttccagttggaggaaaatcgaaagttctacggggtgtaacgtttcccggttaggaacgggggcccgtaatttcccaaccctaattcccgtacccgaaggaacggaaacctaaacgttaccccggaaaggaaaccaaccgtaaggttcgttacctttactttaccaaaattacgaaaccgtacggaccctagaaccgaacccttacgaacggaaccgaaccgggtccgttagtttacgtttttggttcggaccgtaaggtaaccttattaccgttacgttttaacctaaaaacgtttccggtttaccttacgttaccgtaaccggtcccggtacgggggtaaccccgg

SEQ ID NO: 424906 - DNA, 536 bp, Homo sapiens
  misc_feature: GZ8MTXP02GBS8D.44.27.C05.1.454.CMB.2.raw
  modified_base (371)..(371): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccagtagggggtccctgagactctcctgtgcagcctctggatacaccttcgataattggaatatgcagtggtccgcaggctccaggcgaggggctggagtgggtggcaggtgtgtcatttcatggagaatcagtctacggtnattccgtgagggccattcaccatctccagagacattcgagaacacagtgtctcttacaaatagaacagcctagagacctcacggacacggccgtcgttatttgtgtcgagactatctgtttaacctaaaagttcggttactacgtttcgacggtcgtaccggggg

SEQ ID NO: 424907 - DNA, 602 bp, Homo sapiens
  misc_feature: GZ8MTXP02IXSZK.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcggtggccccaggtacggggggtccctgagactctcctgtgcagcctctggattcaccttcgataattggaatatgcaggtcggtcccgcaggctccgaggcggaggggctgggagtggggtggcagggtgtgtctatttccagtggaggaaatcgaagttctacgggtgtagttcccggttgacggggccgattccaccatcctcagagacacgttcgacgaacacagtcgtctacttacaaatgaacacgacctagacgacctacgacggaccgacgggtccgttagtttacgttttcggtgtacgtacgtacttacgttacttacgtttaacctaaaacgttcggttactacgttccgaccgtccggtacggggacccgg

SEQ ID NO: 424908 - DNA, 510 bp, Homo sapiens
  misc_feature: GZ8MTXP02GZ3OW.44.27.C05.1.454.CMB.2.raw
  modified_base (189)..(189): a, c, t, g, unknown or other
  modified_base (223)..(223): a, c, t, g, unknown or other
  modified_base (319)..(319): a, c, t, g, unknown or other
  modified_base (358)..(358): a, c, t, g, unknown or other
  modified_base (418)..(418): a, c, t, g, unknown or other
tcagacagtatatacacgaccggtgctcgatttagacgcgatcgaacggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctggtatcaacatcatccaggtaaacgcccccaaatcatcatctatgagcctataagagccctnagggtttcaatcgcttcacctgcctcaagtccggcaacncggcctcctgacatctctgggctcagctgagacgagctgattattattgttgcttcagtntgttcgtgctatcactttatgtcttggaagttcggaccaaggtcaccggtctaggtcacgacccaaggcccaacccactcgtcactctcccg

SEQ ID NO: 424909 - DNA, 529 bp, Homo sapiens
  misc_feature: GZ8MTXP02JV3YQ.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgcaggctccaggcgaggggctgggagtgggtggcaggtgtgtcatttccatgggaggaaatcaagtctacgggtgattccgttgagggccgattcaccatctccagagacaattccgagaacacagtgtctcttcaaatgaacagcctgagacctcaggacacggccgtgttattttgtgcgagactatctgttaccaaagtcggttactacttcgacgcgtcgggaccg

SEQ ID NO: 424910 - DNA, 706 bp, Homo sapiens
  misc_feature: GZ8MTXP02JQY0S.44.27.C05.1.454.CMB.2.raw
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctgggagtggggtggcaggtgtgtcatttcatggagaaatcaagtctacggtgattccgtgaggccgattcaccatctccagagacaattccgagaacacagtgtctcttacaaatcgaacagccctagacgaccctacgacgggaccaacggggtcccgttagtttacgtttttttgggcgtaccggtaaacgtaaccttaaactttccgttacggtttttaacccctaaaaaagtttcccggggtttacctaacgttttccggaacccggtcccgttacgggggaccccgtacgggggtaaaccccgttcgggttacccgaaccccggttccgttccccgtccgggtccccttacccgaacccgtaaacggggccccctaacgttcccgggttcccttcccccgtcggtcccgtcccctcgccgtcccgacggcgacccaacccgtccgacgacgccacgcgccggccccgg

SEQ ID NO: 424911 - DNA, 563 bp, Homo sapiens
  misc_feature: GZ8MTXP02HVQLX.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccaggtaggggggtccctgagactctcctgtgcagcctctggattcaccttcgataattggaatatgcagtggtccgccaggctccgaggcgaggggctgggagtgggtggcaggtgtgtcatttcgagtggaggaaatcaagtctacgggtgattccggttgagggcccgtattcccacctatctccagagacaattccgagaacacagtgtacttcttacaaatagaacagccctagacgacctacgaggaccacggccgtgttattttgtgacgagactacgttctcgtttaccaaaagttcggttactacgttcgaccgtccgtcggggaccg

SEQ ID NO: 424912 - DNA, 640 bp, Homo sapiens
  misc_feature: GZ8MTXP02ILAZ7.44.27.C05.1.454.CMB.2.raw
  modified_base (289)..(289): a, c, t, g, unknown or other
  modified_base (300)..(300): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataatggaatangcagtggtccnccaggctccgaggcgaggggctgggaggtgggtggcagggtgtggtctatttccagtggaaggaaatcgaaagttctacgggtgatttccggttgacggggtcccgtaattcccaccgtactctaccgagagaactaacgttaccgaagaacacagtgtctcttacaaatagaaacacgacctagacgaccgtacgaacggaccgaaccgggtccgtagtttacgtttttggtacggtccggtaaggtaaccttagttaccgtttacgtttaaccccgtaaaaagttccgggtttaactaacgttaccggtaaccgcccggttacgggggtaacccccgg

SEQ ID NO: 424913 - DNA, 527 bp, Homo sapiens
  misc_feature: GZ8MTXP02I2OH0.44.27.C05.1.454.CMB.2.raw
  modified_base (319)..(319): a, c, t, g, unknown or other
  modified_base (362)..(362): a, c, t, g, unknown or other
  modified_base (370)..(370): a, c, t, g, unknown or other
  modified_base (509)..(509): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctggtatcaacatcatccaggtaacgcccccaaactcatcatctatgagcctataagagccctntaggggtttctaatcgtcttcacctgcctcaacgtccgcaacncgcctccngacaatctctgggcctcgaggctgaggacgaggctgtattattattgttgctcagtattgttcgtcgcatcattactgtcgttggaagttcgggaacaacggtcaccgttctacggtcacggacccaaggcccaacccnctacgtccactcctcccg

SEQ ID NO: 424914 - DNA, 553 bp, Homo sapiens
  misc_feature: GZ8MTXP02I50CZ.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtggtccgcaggctccgaggcgaggggctggagtggggtggcaggtgtgtcatttccatggagaaatcaagtctacgggtgagttccgttgagggtccgattcaccatctccagagacaattccgaagaacacagtgtctcttacaaatgaacagaccctgacgacctcgacggacacggccgtgttacgttttgtgacgtagtactatacgtgtttacccaaaagttcggttacacttcgacgtccgtcggggtacccgg

SEQ ID NO: 424915 - DNA, 527 bp, Homo sapiens
  misc_feature: GZ8MTXP02FSSD4.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (281)..(281): a, c, t, g, unknown or other
  modified_base (318)..(318): a, c, t, g, unknown or other
  modified_base (442)..(442): a, c, t, g, unknown or other
  modified_base (445)..(445): a, c, t, g, unknown or other
  modified_base (449)..(449): a, c, t, g, unknown or other
  modified_base (457)..(457): a, c, t, g, unknown or other
  modified_base (467)..(467): a, c, t, g, unknown or other
  modified_base (498)..(498): a, c, t, g, unknown or other
  modified_base (512)..(512): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaactttgtctctgtatcaacatcatccaagtaaacnccccaaatcatcatctatgagcctaatagacgccctnagggtttcaatcgcttcactcgacctcaaacgtcccggacaacgaccggtccctccgtagaaccaacttcgtacgttcgggaccttccgaaggtctaggacggacgagctagatttatatgttnctnagtntgttcgcncatctattangtctagagtggacctaggtcacgtctagcancccaagcccaaccnctgtcacgtctcccg

SEQ ID NO: 424916 - DNA, 574 bp, Homo sapiens
  misc_feature: GZ8MTXP02F0V9C.44.27.C05.1.454.CMB.2.raw
  modified_base (379)..(379): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccgcaggctccaggcgaggggctgggagtggggtggcgaggtgtgtctatttccagtggaggaaatcaagttctacgggtnatttccggttgacgggtccgattccgaccatctaccagagacaattccgaagaacacagtgtctacttacaaatagaacacgcctagacgacctcgaacggacgacggtccgttagttacgttttgtgtcgagtactactcgttacgtttaccaaaagttcgttactacttcgtacgtccgtacggggtacccgg

SEQ ID NO: 424917 - DNA, 601 bp, Homo sapiens
  misc_feature: GZ8MTXP02G9L5F.44.27.C05.1.454.CMB.2.raw
  modified_base (189)..(189): a, c, t, g, unknown or other
  modified_base (223)..(223): a, c, t, g, unknown or other
  modified_base (280)..(280): a, c, t, g, unknown or other
  modified_base (359)..(359): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattctagtcttaacttgtctcctgtatcacatcatccaaggtaaacnccccaaactcatcatctatgagctataagacgccctgtagggtttcaatcgcttcacctcgcctcaacgtccgacaacnccggcctcctgacaactcgtcgtcgggcctccgacggtctaggacggacgaggtctagtaatttagttattgttgctacagtattgttcgtcgactacttctaacgtttagtgttacgtttacgggaacggttacgggaacccgtaaacgggttccctaaacccggttccgtaacggtaccgacgtacccccgaaacggaccccaaaccccgtacgtctttaccaccttcccgtttccccgg

SEQ ID NO: 424918 - DNA, 585 bp, Homo sapiens
  misc_feature: GZ8MTXP02IHKLU.44.27.C05.1.454.CMB.2.raw
  modified_base (377)..(377): a, c, t, g, unknown or other
  modified_base (407)..(407): a, c, t, g, unknown or other
  modified_base (419)..(419): a, c, t, g, unknown or other
  modified_base (428)..(428): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcacttcgataattggaatatgcagtggtcccgccaggctccgaggcgaggggctgggagtggggtggcaggtgtgtctatttccagtggagaaatcaaagtctagggtntattccgtgacgggcattcacatctcaganactactaccganaacacagtntctacttacaaatacgaacacgaccgtacgacgacctacgacggacgacgggtccgttagtttacgttttggtacgtacgtacgtacttacgttacgttacgtttaacctaaaagttcgttacgtacgttaccggtaccggtccggtacggggaccg

SEQ ID NO: 424919 - DNA, 541 bp, Homo sapiens
  misc_feature: GZ8MTXP02FQ2EO.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccaggcgaggggctgggagtgggtggcgaggtgtgtcatttcagtggaggaaatcaagtctacgggtgattccgttgagggccgattcaccatctcagagacattccgaagaacacagtgtactacttcaaatgaacagacctgagacctcaggacacggccgtagttattttgtgcgtagactacttctgtttaccaaaagttcgttactacttcgacgtccgtggggacccg

SEQ ID NO: 424920 - DNA, 381 bp, Homo sapiens
  misc_feature: GZ8MTXP02HNB9X.44.27.C05.1.454.CMB.2.raw
  modified_base (274)..(274): a, c, t, g, unknown or other
  modified_base (278)..(278): a, c, t, g, unknown or other
  modified_base (380)..(381): a, c, t, g, unknown or other
tcagacagtatatacacgaccggtgctcgatttagacgcgatcgaagggtttgggacagagtcaccattaccgcggacgaatccacgagtacagcctacatggagctgagcaggctgagatctgaagacacggccatctatttctgtgcgagagccctcgtcaactttcatagtccctctcatagtcccacacatggaaattggttcgacccctggggccagggaaccctggtcaccgtctcctcagcttccacaaggcccatcggtctccccnggcnccctgctccaggagcacctccgagagcacagccggccctgggctgcctggtcaaggctacttcctatactactgtctgacgcgggctggcaaggcgcatagnn

SEQ ID NO: 424921 - DNA, 547 bp, Homo sapiens
  misc_feature: GZ8MTXP02GCHP6.44.27.C05.1.454.CMB.2.raw
  modified_base (188)..(188): a, c, t, g, unknown or other
  modified_base (222)..(222): a, c, t, g, unknown or other
  modified_base (235)..(235): a, c, t, g, unknown or other
  modified_base (283)..(283): a, c, t, g, unknown or other
  modified_base (371)..(371): a, c, t, g, unknown or other
  modified_base (433)..(433): a, c, t, g, unknown or other
  modified_base (437)..(437): a, c, t, g, unknown or other
  modified_base (446)..(446): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatnttcttagtcttaacttgtctcctggtatcaacatcatccaggtaaacncccccaaactcatcatctatgaggcctataagacggtccctcgtaggggtttctaaagtcgtcttcacctgcctcaacgtccgcaacncggcctcctgacaatctctcgggctccgaggctgacggacgaggctgattattattgtgctnagtntcgttggcncatctacttatgtcttcggaagttcgggacctaaggtcctaaccgtcgtaggtccacgacccaaacggccccaaacccgtctcgtacctaccttcgtcccg

SEQ ID NO: 424922 - DNA, 709 bp, Homo sapiens
  misc_feature: GZ8MTXP02GROFU.44.27.C05.1.454.CMB.2.raw
  modified_base (260)..(260): a, c, t, g, unknown or other
  modified_base (266)..(266): a, c, t, g, unknown or other
  modified_base (285)..(285): a, c, t, g, unknown or other
tcagacagtatatacacgaccggtgctcgatttagacgcgatcgaagggtttggggcctgggagacgagcccagcactggaaatcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagctctctgtgcncgctcngatcactgatatgatatgnagtggccgcgagctcgaggcgaggggctgggaggtggggtggcgagggttgtgtctagtttccgagtgggaagtaaactcgaaaggttcgtaggggtgtacgtttccggttagggaccggggtaccgtactttacccgaaccctacttacccgtaccgaacggtaacgtaaaccgtaaaccgttacccggaaacgtaaacccgtaacgtacggttaccgttaccttacctttaaacgaaaacgttacgaaaaccgtacggtacccgtaacggaacgtaacccgtacgaaacggggacccgtaccggggtaccgttaggtttacggtttttaggacggtacgtaacgtactttacgttaccgtttaacgtttaacctaaagttccggttactacgttacgacccggtcggtaccggggaacccgg

SEQ ID NO: 424923 - DNA, 534 bp, Homo sapiens
  misc_feature: GZ8MTXP02I4XXS.44.27.C05.1.454.CMB.2.raw
  modified_base (283)..(283): a, c, t, g, unknown or other
  modified_base (457)..(457): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttaccctcttaagaggtgtcatgtgtcaggtgcaattcgtggagtctgggggaggcgtggccccagtagggggtccctgagactctcctgtgcagcctctggattcaccttcgataattggaatatgcagtggtccncaggctccaggcgaggggctggagtgggtggcaggtgtgtcatttcatggaggaaatcaagtctacggtgattccgtgagggccattcaccatctccagagacaaattcccgagaacacagtgtctcttacaaatgaacagcctgagacctcaggacacggccgtgtattttgngcgagactatctgtttaccaaaattcggttacattcgacgcctggggccaaggaccctggtcaccgtctcctcgccc

SEQ ID NO: 424924 - DNA, 541 bp, Homo sapiens
  misc_feature: GZ8MTXP02GRW7X.44.27.C05.1.454.CMB.2.raw
  modified_base (188)..(188): a, c, t, g, unknown or other
  modified_base (222)..(222): a, c, t, g, unknown or other
  modified_base (234)..(234): a, c, t, g, unknown or other
  modified_base (329)..(329): a, c, t, g, unknown or other
  modified_base (366)..(366): a, c, t, g, unknown or other
  modified_base (425)..(425): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccaaggtaaacgcccccaaatcaattacttttgagtccagtgagcggccgtcaggttntttctaatcgtcttctctggctccaagtctggccacncggcctcctgtcgatctctgggctccggcctgaggacgaggctgactattactgcgctntatttacaatcttgagtacgttgggtgttcgggcggagggactcgaccgttgacccgttctacggtccacgccctaaggcctcgcccccgtcggtcactctcgttccccaccttcc

SEQ ID NO: 424925 - DNA, 597 bp, Homo sapiens
  misc_feature: GZ8MTXP02GFTQK.44.27.C05.1.454.CMB.2.raw
  modified_base (283)..(283): a, c, t, g, unknown or other
  modified_base (368)..(368): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtctctggacagtcggtcaccatctcctgcactggagccagcggtaatattcttagtcttaactttgtctcctggtatcaacatcatccaggtaaacncccccaaactcatcatctatgaggcctataagacggccctcgaggggtttctaaatcgcttcacctgcctcaacgtccggcaacnccggcctccctgacaatctctgggctccgaggctggaggacgagctgtatttattattgttgctcagtattgttcgtcgctatctactttatcgttcgttacgggaaggttcgggaaccctaagggtaccgtacccggttaccgttacgggttaccaacggacccccaaaacggggccccctaaaacccccgtaccgttcggttacccaccggtttacctttcccccgg

SEQ ID NO: 424926 - DNA, 579 bp, Homo sapiens
  misc_feature: GZ8MTXP02G29TY.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccgagtaggggggtccctggagactctcctgtgcagcctctggattcaccttcgataattggaatatgcagtggtccgcaggctccgaggcgaggggctgggagtgggtggcgaggtgtgtcatttcagtggaggaaatcgaaagtctacgggtgtatttccgtgacggggtccgattccaccgatcctaccgagagactaacttccgagaacacagtgtactcttacaaatagaacacgacctagacgacctacgacggacgaccggccgttagttacttttagtgtcgtagacttatacgtacgtttaccaaaagttcgttactacgttacgaccgtccgtacggggacccg

SEQ ID NO: 424927 - DNA, 500 bp, Homo sapiens
  misc_feature: GZ8MTXP02HZK55.44.27.C05.1.454.CMB.2.raw
  modified_base (187)..(187): a, c, t, g, unknown or other
  modified_base (279)..(279): a, c, t, g, unknown or other
  modified_base (356)..(356): a, c, t, g, unknown or other
  modified_base (374)..(374): a, c, t, g, unknown or other
  modified_base (414)..(414): a, c, t, g, unknown or other
  modified_base (418)..(418): a, c, t, g, unknown or other
  modified_base (423)..(424): a, c, t, g, unknown or other
  modified_base (432)..(432): a, c, t, g, unknown or other
  modified_base (487)..(487): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccagtaaancccccaaaatcatcatctatgagcctataagaggccctgagggtttcaatcgcttcacctgcctcaagtccgcaacncggcctcctgacaatctntgggctccaggctgagacgaggctgattattatgttgctnagtntgtcnnatctattntgtcgtaggaagtcggactaggtccacgttactacgcacgaccaacgcccaaccnctcgctactctcg

SEQ ID NO: 424928 - DNA, 737 bp, Homo sapiens
  misc_feature: GZ8MTXP02IZ1BV.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctctggattcaccttcgataattggaatatgcagtggtccgccaggctccgaggcgaggggctggagtgggtggcagggtgtgtcatttcagtggaaggaaatcgaagtcgtaacggtgtacgtttccggtggaacggggtcccgtaagttacctacccgtacttacctaccgaacggaacggtaacctaaaccgtttacccggtaaacggaaaccaaaccgtaacgttacggttaccgttacctttaaccgtaaaacttaacggtaaaaccgaaacgtacccgacggtttttaacgacccgttaaccgaacgggaaccgaaccggggtaccccggtttaacggtttacgttttttggttacgggtaccggtaacggttaaccgttaactttaccgtttaccgtttaaaccgttaaaacgtttaaccggtttaccgttacgtttaccggtaacccggtacccggtttacccggggg

SEQ ID NO: 424929 - DNA, 594 bp, Homo sapiens
  misc_feature: GZ8MTXP02HYSXW.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccaggtaggggggtccctgagactctcctgtgcagcctctggattcaccttcgataattggaatatgcagtggtccgccaggctcaggcgaggggctgggaggtggggtggcgagggtgtgtctatttccagttggaggaaaatcgaaagtctagggtgatttccggttgaggggccgtattccacctatctccagagactaatccgagaacacagtgtctcttacaatagaacacgacctagacgacctcgacggacgacggtccgttagttacgttttggtcgtacgtagtaccttagtacttacgtttaaccgtaaaacgttcggttactacgttaccgtaccggtaccggttacggggacccgg

SEQ ID NO: 424930 - DNA, 541 bp, Homo sapiens
  misc_feature: GZ8MTXP02I0O25.44.27.C05.1.454.CMB.2.raw
  modified_base (304)..(304): a, c, t, g, unknown or other
  modified_base (325)..(325): a, c, t, g, unknown or other
  modified_base (487)..(487): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcagtcggtccnccaggctcgaggcgaggggcnggagtgggtgcaggtgtgtcatttcagtggaagaatcaagtcgtacggtgagttccgtgagggccagtcacatctccagagacacttacgaagaacacagtagtctactactaaatagaacagcctagacgacctcgaggacacggccgtacgtagttttgngtacgagtactatcttagttaacctaaagttcggtactatcgacgtcgtacggg

SEQ ID NO: 424931 - DNA, 625 bp, Homo sapiens
  misc_feature: GZ8MTXP02FGCE6.44.27.C05.1.454.CMB.2.raw
  modified_base (340)..(340): a, c, t, g, unknown or other
  modified_base (463)..(463): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcactcaggacacagggtcctgggcccagtctgccctgactcagcctgcctcgtgtctggttctcctggacagtcatcacatctcctgcactgggtccagcaatgacagttgggatatataaccttgtctcctggtatcaaacaacataccacggaccaaacgacccccaaaatctaatttacttttgagtccagtgacgccggtcgtcgaggttntttactaatccgtcttctctcggctaccaagtcctcggcccacgtaccggcctccgtgtcgtacttccgtcgtcgggtcctcccggaccgtggacggtaccgagggctacgtacttattacgngccgtctacgttaactttaaccaaccttgttagtaagttcggtttggggtcgttcggggacgggtaacgggtacctaccgtaccgttacggacccggtaccgttacggacaccggaacccgaacggtccgttccccggcccccgttcggacctcctttcccg

SEQ ID NO: 424932 - DNA, 576 bp, Homo sapiens
  misc_feature: GZ8MTXP02IZ6TD.44.27.C05.1.454.CMB.2.raw
  modified_base (384)..(384): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccgcaggctccgaggcgaggggctggagtggggtgcgaggtgtgtcatttcagtggaggaaatcgaaagtcgtacggtgattccgtgagggccgattccacntcctccagacgacaattccgaagaacacagtgtctcttacaaatgaacagcctagacgacctacgaggaccacggtaccgtgttagttttggtagcgtagtactatcttagttactaaaacttcggtactacttcgacgtccgtcggggaaccgacgggtacccgtcggtaccgtaccgtctcccgtcccgg

SEQ ID NO: 424933 - DNA, 633 bp, Homo sapiens
  misc_feature: GZ8MTXP02IZV8X.44.27.C05.1.454.CMB.2.raw
  modified_base (213)..(213): a, c, t, g, unknown or other
  modified_base (277)..(277): a, c, t, g, unknown or other
  modified_base (295)..(295): a, c, t, g, unknown or other
  modified_base (303)..(303): a, c, t, g, unknown or other
  modified_base (311)..(311): a, c, t, g, unknown or other
  modified_base (315)..(315): a, c, t, g, unknown or other
  modified_base (319)..(319): a, c, t, g, unknown or other
  modified_base (338)..(338): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccncaggctccaggcgagggctggagtgggtgcaggtgtgtcatttcatggagaatcaagtctagtnattcgtgaggccatcacntctcaganacatcganaacnagtntctctacaaatcgaaaacngacctagacgtaccctacgacgggacctaaccgggtccgttagtttacgtttttggacgtacgtaagtacttacttacgttacgtttaacctaaaagttcgttactacgttacgaccgtccgtacgggaccgtaacgggtaacccgtcggtaccacccgtcctcccgtccgtccctacccgaaccgaaccggtccctacgtcccgtcccttccccgtcggtcccgtcccgtcgtccctaccgacggaccgaccaacccgtaccgacgaccgaccgaccgtaccggcccggtcccg

SEQ ID NO: 424934 - DNA, 554 bp, Homo sapiens
  misc_feature: GZ8MTXP02GO5O7.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccgaggcgaggggctgggagtggggtggcaggtgtgtcatttcatggaggaaatcaagtcgtacgggtgacgttccgttgagggtccgtattcgacctactctacccgagagacaacttccgaagaacacagtgtctacttacaaatagaacagcctagacgactcgacggacacggccgtcgtattttgcgtcgacgtactactctgttaaccaaatcggttacagttcgacgtcgtcggg

SEQ ID NO: 424935 - DNA, 558 bp, Homo sapiens
  misc_feature: GZ8MTXP02FY152.44.27.C05.1.454.CMB.2.raw
  modified_base (400)..(400): a, c, t, g, unknown or other
  modified_base (422)..(422): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccgcaggctccaggcgaggggctggagtgggtggcaggtgtgtcatttcatggaggaatcgaagtctacggtgattccgttgagggccattcacatcnccagagacataccgaagacacngtagtctacttacaaatgaacagcctagacgacctcacggaccacggccgtgttagtttttggtcgacgtagacttaactcgttacgttaaccgtaaaacgttcggttactacgttacgaccgtccgtaccggggg

SEQ ID NO: 424936 - DNA, 532 bp, Homo sapiens
  misc_feature: GZ8MTXP02I4PY2.44.27.C05.1.454.CMB.2.raw
  modified_base (188)..(188): a, c, t, g, unknown or other
  modified_base (222)..(222): a, c, t, g, unknown or other
  modified_base (268)..(268): a, c, t, g, unknown or other
  modified_base (283)..(283): a, c, t, g, unknown or other
  modified_base (360)..(360): a, c, t, g, unknown or other
  modified_base (379)..(379): a, c, t, g, unknown or other
  modified_base (421)..(421): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacntcatccaggtaaacncccccaaatcatcatctatgaggcctataagaggccctcaggggtttctaatcgcttcactgcctcagtccgcaacncggcctcctgacaatctcnggctccaggctgaggacgaggctgatttatattgttgacttnagtatgttcggtcactatcacttatcgtctttacggagttcggactaaacggtctaccgtacgtacgtacacgacccaacggcccaacccctactcgtacactctttcccg

SEQ ID NO: 424937 - DNA, 515 bp, Homo sapiens
  misc_feature: GZ8MTXP02FFSML.44.27.C05.1.454.CMB.2.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgaggcctataagaggccctcaggggtttctaatcgcttcacctgcctccaagtccggcaacacggcctccctgacaatctctgggctccaggctgaggacgagctgattattattgttgctcagatgttcgtcgcatcacttatgtcttcgaagtcgggacaaggtcaccgtcctagtcagcccaaggcccaaccccactcgtacactctcg

SEQ ID NO: 424938 - DNA, 533 bp, Homo sapiens
  misc_feature: GZ8MTXP02FQ82D.44.27.C05.1.454.CMB.2.raw
  modified_base (223)..(223): a, c, t, g, unknown or other
  modified_base (235)..(235): a, c, t, g, unknown or other
  modified_base (312)..(312): a, c, t, g, unknown or other
  modified_base (365)..(365): a, c, t, g, unknown or other
  modified_base (427)..(427): a, c, t, g, unknown or other
  modified_base (527)..(527): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaactttgtctcctggtatcaacatcatccaagtaaacgcccccaaactcatcatctatgagcctanaagacgccctgagggtttcaatcgtctcacctgcctacaacgtccggacaacnccggcctcctgaccaatctctgggctccgagctgaggacgagctgattatattgtgctcagntgttcgcgcatctactttatcgttcgtacggtaaggtcgggaacgtacggtcctaccgtcgtacgtcacgcccaagtccggacccaaccctctcgtaccncttccg

SEQ ID NO: 424939 - DNA, 551 bp, Homo sapiens
  misc_feature: GZ8MTXP02G5B0S.44.27.C05.1.454.CMB.2.raw
  modified_base (188)..(188): a, c, t, g, unknown or other
  modified_base (240)..(240): a, c, t, g, unknown or other
tcagacagtatatacacgaccggtgctcgatttagacgcgatcgaagggtttgggggggtcacaagaggcagcgctctcgggaagtctccaccatggcctgggctctgctgctcctcactctcctcactcaggacacagggtcctgggcccagtctgccctgactcagcctgcctcgtgtctgggtcncctggacagtcgtcaccatctcctgcactgggtccagcaatgacattggganatataaccttgtctcctgtatcaaacaacatccaggacaaagacccccaaatcattacttttgatccagtgagcggcgtcaggttgttactaatcgccttctctggctaccaagttctcggcccacaccggtccctccctgtccgatctctcgggtcctccggcctgacggacgaggctgactattactgcgctatattacaactgtgagtacgttgggtgttcgggacggaggactccgaccgtcgacccgtcgtacgtccacggacccaaaggccctccggtcccccgtcggtaccaccttcgtccccg

SEQ ID NO: 424940 - DNA, 727 bp, Homo sapiens
  misc_feature: GZ8MTXP02GK1D2.44.27.C05.1.454.CMB.2.raw
  modified_base (212)..(212): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccnccaggctccaggcgaggggctggagtgggtggcaggtgtgtcatttcatggaggaatcaagtctacggtgattccgtgaggccgattcacatctccagagacaattccgagaacacagtgtctcttacaaaatgaaacagcctgacgacctcgagggacacgggtccgttgttaacttttttggcgccggtaagtacgttaaattcgttacgttttaaccctaaaaacgtttccggtttactaacgtttccggaaccgtcccggttacgggggacccgtaacgggggaaaccccgttcggggtacccgtaacccggttcccgttacccgtcccgggtcccttaccccgaaacccgtaaacgggggccccctaacggttccccgggttcccgtttcccccccgttcggggccccgtcccccgttcgggtcccttacccggaacgggtacgaccccgtaacccgtaccccgggacggaaccggcccgaaaccggaccgggtcccggggtcccccggg

SEQ ID NO: 424941 - DNA, 558 bp, Homo sapiens
  misc_feature: GZ8MTXP02IERVE.44.27.C05.1.454.CMB.2.raw
  modified_base (374)..(374): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctctggattcacttcgataattggaatatgcagtggtccgcaggctccaggcgaggggctgggagtggggtggcagggtgtgtcatttccagtggagaaatcaaagtctacgggtnatttccggttgaggggccgatttccacctagtctccagagacaattccgagaacacagtgtctcttacaaatgaacagacctgacgacctcacggacacggccgtgttacttttgtgcgtagacttactcttgtttacctaaaagttcggttactacgttccgaccggtccgtacggggacccg

SEQ ID NO: 424942 - DNA, 515 bp, Homo sapiens
  misc_feature: GZ8MTXP02HYDKR.44.27.C05.1.454.CMB.2.raw
  modified_base (187)..(187): a, c, t, g, unknown or other
  modified_base (369)..(369): a, c, t, g, unknown or other
  modified_base (433)..(433): a, c, t, g, unknown or other
  modified_base (442)..(442): a, c, t, g, unknown or other
  modified_base (503)..(503): a, c, t, g, unknown or other
  modified_base (507)..(507): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctctggtatcaacatcatccaagtaaagcccccaaatcatcatctatgacggcctaataagacggccctcgtaaggggtttctaaatcgctttcacctgccctcaagtccggacaacnccggcctcctgacaatctctgggctcaggctgaggcgaggctgattattattgttgcttcagtntgttcgtcncatcacttatgtctcggaagtcggacaaggtcaccgtctagtccagcccaagccaaacccnctcncactctcg

SEQ ID NO: 424943 - DNA, 548 bp, Homo sapiens
  misc_feature: GZ8MTXP02GD03K.44.27.C05.1.454.CMB.2.raw
  modified_base (189)..(189): a, c, t, g, unknown or other
  modified_base (367)..(367): a, c, t, g, unknown or other
  modified_base (423)..(423): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaaggtaaacgcccccaaaatcatcatctatgagcctaataagaggccctgaggggtttctaaatcgcttcacctgcctacaagtccgcaacncggcctcctgacatctctggctccaggctgaggacgagctgattatattgttgctnagtatgttcgcgctatctactttagtgttaccgttgggaaagttcgggaacctaaagggttccacccggttctaggtaccacgaccccaaaggccccaaaccccactcgtaccacttccttcccg

SEQ ID NO: 424944 - DNA, 534 bp, Homo sapiens
  misc_feature: GZ8MTXP02GV0H1.44.27.C05.1.454.CMB.2.raw
  modified_base (188)..(188): a, c, t, g, unknown or other
  modified_base (222)..(222): a, c, t, g, unknown or other
  modified_base (259)..(259): a, c, t, g, unknown or other
  modified_base (263)..(263): a, c, t, g, unknown or other
  modified_base (279)..(279): a, c, t, g, unknown or other
  modified_base (369)..(369): a, c, t, g, unknown or other
  modified_base (437)..(437): a, c, t, g, unknown or other
  modified_base (525)..(525): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattctagtcttaacttgtctctgtatnaacntcatccaaggtaaacncccccaaatcatcatctatgagcctaataagacggccctacgtaggggtttactaatcgctttcacctcgcctacaacgtccggacaacnccggcctccctagaccaatctcgtgggcctcgaggctaggaggacgagctgtattattatgttagctnagtattgttcgcatatcctatttatgttcgttacggaagttcgggaaccaggtccacggtctaggcaacgccaacgcccaacccatcncacctctcc

SEQ ID NO: 424945 - DNA, 555 bp, Homo sapiens
  misc_feature: GZ8MTXP02G0VBP.44.27.C05.1.454.CMB.2.raw
  modified_base (189)..(189): a, c, t, g, unknown or other
  modified_base (223)..(223): a, c, t, g, unknown or other
  modified_base (367)..(367): a, c, t, g, unknown or other
  modified_base (532)..(532): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaattattcttagtcttaactttgtctcctgtatcaacatcatcagtaaacgaccccaaactcatcatctatgaggcctaataagacggccctcgtaggggtttcaagtcgcttcacctgcctcaagtccgacaacncgcctcctgacaatctctgggactccgaggctaggaggacgaggtctagatttattatgttgctacagtattggttcgtcgctatcgtattagtgttcgtacggaagttcgggaacctaggtccaccggtcgtacggtacacgtacccaacggaccccaacccgnttaccgctaccgttcttaccccg

SEQ ID NO: 424946 - DNA, 544 bp, Homo sapiens
  misc_feature: GZ8MTXP02HV3KA.44.27.C05.1.454.CMB.2.raw
  modified_base (222)..(222): a, c, t, g, unknown or other
  modified_base (318)..(318): a, c, t, g, unknown or other
  modified_base (357)..(357): a, c, t, g, unknown or other
  modified_base (418)..(418): a, c, t, g, unknown or other
  modified_base (431)..(431): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaacttgtctcctggtatcaacatcatccaggtaaagcccccaaatcatcatctatgagctataagaggccctntaggggttctaatcgcttcacctgcctcaagtcgcaacncggcctcctgacaatctctgggctccgaggctgaggacgaggctgattattattgtgcttnagtattgttcgcncatctacgttatgtcgttacgggaaagttgggaacccaagggtccaccggttcctaacgggtccacgcccgaaacgggccccaaaacccgcctctacctcgttcctttccccg

SEQ ID NO: 424947 - DNA, 738 bp, Homo sapiens
  misc_feature: GZ8MTXP02HXC3Q.44.27.C05.1.454.CMB.2.raw
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctcgaggcgaggggctgggaggtggggtggcgagggtgtggtctatttcgagttgggaaggtaaatcgaaaggttccgtacgggttgtacgtttcccggttaggggacggggtacccgtaagttaccctaaccgtaacttccctaccgaacgaacggtaacctaaacgtttacccggaaacggaaaccaaaccgtaaggttacgttacctttaccgtttaacctaaaagttacggaaacacgtaccgtacgaacggtaaccctacgaacgggaaccgtaccgggtacccggttaggtttaacgtttttggttacggtaccggtaacgtaaccgttaacgtttaccgtttacggttttaaacccgttaaaaacgtttccggtttaccgttaaacgtttcccggtaacccggttcccgggttacccggggg

SEQ ID NO: 424948 - DNA, 534 bp, Homo sapiens
  misc_feature: GZ8MTXP02GFHVY.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtgggtccgcaggctccaggcgaggggatgggagtggggtggcgagggtgtgtcatttccatggagaaatcaagtctacggtgattccgttgagggccattcacatctccagagacaattccgaagaacacagtgtctcttacaaatgaacagcctgacgacctcaggacacggctgttactttgtgcgagactatactgttaccaaaagttcggtactacgttcgacgcgtcgggtacccg

SEQ ID NO: 424949 - DNA, 551 bp, Homo sapiens
  misc_feature: GZ8MTXP02FMCJH.44.27.C05.1.454.CMB.2.raw
  modified_base (484)..(484): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtaggggggtccctgagactctcctgtgcagcctctggattcaccttcgataattggaatatgcagtgggtccgccaggctccgaggcgaggggctgggagtggggtggcgagggtgtggtcatttccatggaggaaatcaagtctacggtgattccgttgagggccgatcacatctccagagacaatccgagaacacagtgtctctacaaatgaactagcctagagacctacgagacacggccgtgttacgttttgngtcgtagacgtacttctcgtttaccaaaagttcggttactacttcgaccgtccgtcggggtacccgg

SEQ ID NO: 424950 - DNA, 537 bp, Homo sapiens
  misc_feature: GZ8MTXP02GBQIB.44.27.C05.1.454.CMB.2.raw
  modified_base (188)..(188): a, c, t, g, unknown or other
  modified_base (222)..(222): a, c, t, g, unknown or other
  modified_base (368)..(368): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggttaatattcttagtcttaactttgtctcctggtatcaacatcatccaggtaaacgcccccaaactcatcatctatgaggacctataagagccctcgaggggtttactaatcgcttcacctgcctcaacgtccgacaacncggcctcctgacaatctcgtcggctccaggctagaggacgagctgattatattgttgctcgagtagtgttcgtcgcatctattatgtacttggaagttcggacctaaggtctaccgtctacggtaccacgacccgaacggcccaacccgactcgtacactcgttacccc

SEQ ID NO: 424951 - DNA, 674 bp, Homo sapiens
  misc_feature: GZ8MTXP02IC7ER.44.27.C05.1.454.CMB.2.raw
  modified_base (307)..(307): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcacttcgataatggatatgcagtggtccgcaggctccgnggcgaggggctgggagtggggtggcagggtgtgtctatttccagtagggagaaatcgaaagttcgtacgggtgtagtttcccggttgacggggccgtattcccgacctatcctaccgaacgacgaactaaacgtttacccgaaacgaaaccaacgtagtacgttaccttacctttaaccaaaagttacgaaaccgtacgacccgttacggaacgtaccctacgaacgggaccgtaaccggggtcccggtttaggtttaacgtttttggtacggtacggtaacgtaacttacttacgtttacgtttaacctaaaacgtttccggtttactacgtttaccggaccggtcccggttacgggggaccccgg

SEQ ID NO: 424952 - DNA, 544 bp, Homo sapiens
  misc_feature: GZ8MTXP02FJA2O.44.27.C05.1.454.CMB.2.raw
  modified_base (171)..(171): a, c, t, g, unknown or other
  modified_base (264)..(264): a, c, t, g, unknown or other
  modified_base (488)..(488): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggaggcgtggccccaggtagggggtccctgagactctcctgtgcagcctntggattcaccttcgatattggaatatgcagtgggtccgccaggctccgaggcgaggggctgggaggtggggtggcgaggtgtgtctatttccagtggagaaatcaagtctacggtgattccggttgacgggtccgattcacatctccagagacaatccgagaacacagtgtctctacaatgaacagctagacgacctcgaggacgacggccgtgttacttttgngtcgagactactctcgtttacaaaagtcgttactacttcgacgtccgtcgggaccg

SEQ ID NO: 424953 - DNA, 561 bp, Homo sapiens
  misc_feature: GZ8MTXP02JY9QF.44.27.C05.1.454.CMB.2.raw
  modified_base (364)..(364): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaactcatcatctatgaggcctataagaggccctcaggggtttctaatcgcttcacctgcctcaagtccgcaacncggcctccctgacaatctctggctccagctgaggacgaggctgattattattgttgctcagatgttcgtcgctatcactttatgttcgttacggaaggttcggggaacctaagggtcctaaaccggttccgtaacgggttccacggaccccaaacgggaccccaaacccccgacttcgtacctaccttctttcccgg

SEQ ID NO: 424954 - DNA, 702 bp, Homo sapiens
  misc_feature: GZ8MTXP02I4DEG.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccaggcgaggggctggagtggggtggcgtagggtgtgtctagtttccagtggaggaaaattcgaagttctacggggtgaagtttcccggtagacggggcccgtatttcccgacctactcctaccgaacgaacgtaacctaaagtttaccccggaaaggaaacccaacgaacggttcggttaccttacctttaaccaaaattaggaaaccagacccgttacgaacgacctaccgaacggaccgaaaccgggtcccgttagtttacgtttttaggtaccggacggtaagtaaaccgtttacttaccgtttacgttttaaaccccgaaaaacgtttccgggttaaccttaaacggtttaccggtaacccggtcccggtttacgggggaaacccccggg

SEQ ID NO: 424955 - DNA, 504 bp, Homo sapiens
  misc_feature: GZ8MTXP02F7GYQ.44.27.C05.1.454.CMB.2.raw
  modified_base (221)..(221): a, c, t, g, unknown or other
  modified_base (358)..(358): a, c, t, g, unknown or other
  modified_base (417)..(417): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaagcccccaaatcatcatctatgagcctataagagccctcaggggtttctaatcgcttcacctgcctcaagtccgcaacncggcctcctgaccaatctctgggctccaggctgaggacgagctgattatattgtagctnagtatgttcgtgcatcacttatgtctcggaagtcggacaaggtcaccgtctaggtcagcccaagccaaacccgctcgtcactctccg

SEQ ID NO: 424956 - DNA, 618 bp, Homo sapiens
  misc_feature: GZ8MTXP02IE9IF.44.27.C05.1.454.CMB.2.raw
  modified_base (267)..(267): a, c, t, g, unknown or other
  modified_base (303)..(303): a, c, t, g, unknown or other
  modified_base (383)..(383): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntggattcaccttcgatatggaatatgcagtggtccncaggctcgaggcggaggggctgggagtggggtggcgagggtgtgtctagtttcgagtggagaatcgaagtcgtacgggtntacgtttccgtaggacggggcctagttaccaccatcctaccagacgactaacttccgaagaacacagtcgtcttcttacaaattacgaaactacgacccgtagacgacccgtacgaacggaccgacggtaccgttgtttaacgtttttggactacggtaacgtaccttaacttcgttacgtttaaccgtaaaacgttcggttactacgtttaccggaccgtaccggtaccggggg

SEQ ID NO: 424957 - DNA, 512 bp, Homo sapiens
  misc_feature: GZ8MTXP02FJW8B.44.27.C05.1.454.CMB.2.raw
  modified_base (365)..(365): a, c, t, g, unknown or other
  modified_base (394)..(394): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaactcatcatctatgaggcctataagaggccctcaggggtttctaaatcgcttcacctgcctcaagtccgcaacncggcctcctgacaatctctgggctcagcngagacgagctgattatattgttgctcagatgttcgtcgctatcacttatgtcttgggaagtcggaccaggtcaccgtcgtaggcatgtcgactacgaggaatacgaccgaggaagggg

SEQ ID NO: 424958 - DNA, 554 bp, Homo sapiens
  misc_feature: GZ8MTXP02GVQSH.44.27.C05.1.454.CMB.2.raw
  modified_base (372)..(372): a, c, t, g, unknown or other
  modified_base (394)..(394): a, c, t, g, unknown or other
  modified_base (403)..(403): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtagggggtccctgagactctcctgtgcagcctctggattcaccttcgataattggaatatgcagtgggtccgccaggctccaggcgaggggctgggagtggggtggcagggtgtgtcatttcatggaggaatcaagtctaggtnattccgtgagggccgattcacntctccaganacaatccgagaacacagtgtactcttacaaattgaaacacggacctagagacctacgaaggaccgacggccgtagttacttttggtcgtcgtagactatacgtgtttaccaaaagttcggttactacttcgacgtccgtacgggtacccgg

SEQ ID NO: 424959 - DNA, 604 bp, Homo sapiens
  misc_feature: GZ8MTXP02IYU3J.44.27.C05.1.454.CMB.2.raw
  modified_base (429)..(429): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggtttcctcgttgccctctaagaggtgtcatgtgtcaggtgcaattcgtggagtctgggggaggcgtggccccaggtagggggtccctgagactctcctgtgcagcctctggattcaccttcgataattggaatatgcagtggtccgcaggctcaggcgaggggctggagtgggtggcagggtgtgtcagtttccagtggaggaaatcaaagttctacgggtgtagtttccgttggacggggtccgagttccaccatctccagagacaattccgaanaacacagtcgtactacttactaatagaacacgaccgtacgacgtaccgtacgacggacgacggtaccgttacggtttacgtttaggtcggtacgtaacgtacgttacgttacgttacgtttaacctaaaacgttcggttactacgttaccgtaccggtccggtacggggtaccgg

SEQ ID NO: 424960 - DNA, 767 bp, Homo sapiens
  misc_feature: GZ8MTXP02IQDJ3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggaggcgtggccccgaggtagggggtccctgagactctcctgtgcagcctctggattcaccttgataattggaatatgcagtggtccgcaggctcgaggcggaggggctgggaggtggggtggcgagggtgtgtctagtttccagtggaaggtaaatcgaaaggttcgttacgggtgtacgtttccgggttaggacggggtccgtatttacccaaccctatacccttccgaaaggaacgtaaacccgtaaaacgtttccccggaaaagaaaccgtaacgtacgttccgttaccttaaccgttaaactaaaacgttacgaaaaccgtacggtacccgtacggtaaccgtaacccgtaacgggaaaccgggtaacccgtaaccggggttaccgtttaggtttttaacggttttcgggttacggtaccggttaaacgttacgtttacgtttaaccgttttaaccgttttaaaacccgttaaaacggtttacccggttttaaccgttaaccggttacccggtacccgggtacccggggttacccgggggtacccgg

SEQ ID NO: 424961 - DNA, 570 bp, Homo sapiens
  misc_feature: GZ8MTXP02GT38Q.44.27.C05.1.454.CMB.2.raw
  modified_base (303)..(303): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatatgcagtggtccncaggctccaggcgaggggctgggagtggggtggcgaggtgtggtctatttccagtggaggaaaatcgaaagttcgtacgggtgacgtttccggttgaggggccgtattccaccatctccagagaacaactaccgagaacacagtgtctctacaatagaacacgactagacgacctcacggacacggtccgtagttacttttggtgtcgagtactactcttacgttaccaaaagttcggttactacttcgaccgccgtacgggaccgg

SEQ ID NO: 424962 - DNA, 526 bp, Homo sapiens
  misc_feature: GZ8MTXP02F6GO0.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctgggagtgggtggcaggtgtgtcatttccatggaggaaatcaaagttctacggtgattccgttgaggggccgattcaccatctccagagacaatccgagaacacatgtctcttcaaatgaacagcctgagacctcaggacacggccgtgtattttgtgcgagactatctgttaccaaaagtcgttacactcgacgccgtgggccg

SEQ ID NO: 424963 - DNA, 563 bp, Homo sapiens
  misc_feature: GZ8MTXP02GTSNS.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (283)..(283): a, c, t, g, unknown or other
  modified_base (360)..(360): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaacttgtctcctggtatcaacatcatccaggtaaacnccccaaatcatcatctatgagcctataagaggccctgagggtttcaaatcgcttcacctgcctcaagtccgacaacncggcctcctgacaatctctgggctcgaggctcgaggacgaggctagattattattgttgctcagtattgttcgtcgctatctactttatgttacttacgggaaagttcggggaaccctaaagggtccaaacccgttcgtacgggtaccacggaccccaaaggcccccaaaaccccgtctacgtacctaccttcgtttaccccg

SEQ ID NO: 424964 - DNA, 582 bp, Homo sapiens
  misc_feature: GZ8MTXP02HV6OE.44.27.C05.1.454.CMB.2.raw
  modified_base (310)..(310): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggtttccgtcgttagcccgtctaagaggtgtcatgtgtcaggtgcaattcgtggagtcgtgggggaggcgtggccccaggtaggggggtccctgagactctcctgtgcagcctctggacttcaccttcgataaattggaatatgcaggtggtccnccgaggctccgaggcgaggggctgggagtggggtggcgaggtggtgtgtattctagtggaggaaagtacaagtcgtacggtgtagttccgttgaggtacggtacttacaccactctccagacgactaacttacgaacgaacacagtgtctcttactaaatagacgacacgtacgacgacgacgacgacgacgtcgtcgttagtttagtcgtacgtacgtactactacttacgttaacgtaacgttacgttactacgtacgtacgtacgtcgg

SEQ ID NO: 424965 - DNA, 565 bp, Homo sapiens
  misc_feature: GZ8MTXP02HEXWW.44.27.C05.1.454.CMB.2.raw
  modified_base (303)..(303): a, c, t, g, unknown or other
  modified_base (377)..(377): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccncaggctccgaggcgaggggctgggagtggggtggcagggtgtgtcatttcatggagaaatcaagtctacgggtnattccggtgacgggccgattccacatctccagagacacttccgagaacacagtgtctcttacaaatagaactacgacctagacgacctcgacggacgacggtccgtgttacgtttgtggcgtagacttactcttacgtttacctaaaacgttcggttactacgttcgaccgtccggtacgggacccgg

SEQ ID NO: 424966 - DNA, 519 bp, Homo sapiens
  misc_feature: GZ8MTXP02FX7RT.44.27.C05.1.454.CMB.2.raw
  modified_base (389)..(389): a, c, t, g, unknown or other
  modified_base (518)..(518): a, c, t, g, unknown or other
tcagacagtatatacacgaccggtgctcgatttagacgcgatcgaagggtttgggaggcgtggccccagtaggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgaggccgattcaccatctccagagacaattccgagaacacagtgtctcttcaaatgaacagcctgagacctcaggacacggccgtgtattttgtgcgagctatctgtttccaaaatcggttcattccgacgcctggggccaggaaccctggtcaccgtctcctcgcctcnccaaggcccatcggtctcccctggcgccctgctccagagcacctccgagagcacagcgcctgggctgcctggtcaaaggctacgttcccatactactcgtctgacgcgggctggcaaaggcgacatagng

SEQ ID NO: 424967 - DNA, 779 bp, Homo sapiens
  misc_feature: GZ8MTXP02INBNE.44.27.C05.1.454.CMB.2.raw
  modified_base (303)..(303): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggtttcctcgttgccctcttaagaggtgtcatgtgtcaggtgcaattcgtggagtcgtgggggaggcgtggccccaggtagggggtccctgagactctcctgtgcagcctctggattcaccttcgataatggaatatgcagtggtccncaggctccgaggcgaggggctgggagtggggtggcaggtgtgtcatttcagtggaggaaatcgaagtctaacgggtgtaacgtttcccggttaggacggggtacccgtagtttacccaaccctaaacttccctaccccgaaaggtaacggaaaccctaaaacgtttaaccccggaaacggaaaacccaaaccgaaacggtttacggttaccctttaccgtttaaccctaaaaagttacgaaaaccgaacggtaaccccgttacggaaaccgaaaccccgttaaccggaaacggggtaaacccgaacccgggggtacccccggtttacggttttaaacgtttttttggtaccggtacggtaaacgggttaaccctttaacgtttaccgtttacggtttttaaacccctaaaaagtttaccccgggtttaacgtaaccgtttacccgggtaacccggtccccggtttaacccgggggg

SEQ ID NO: 424968 - DNA, 646 bp, Homo sapiens
  misc_feature: GZ8MTXP02FW79F.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagctctcctgtgcagcctctggattcaccttcgataattggaatatgcaggtcggtccgccaggctccgaggcggaggggctgggagtggggtggcgtagggtgtggtctagtttccgaagtggaaggaaatccgaaaggttctacggggtgtaacgtttccggttaggacggggccgtatttccaacctatcctaccaaggacaactaactaccgaagaaacacagtgtactcttaacaaatagaacacgcctagacgacctacgaacggacgacggtccgttagtttagttttcggtacgtacggtaaacgtactttactaccgtttaacggtttaacccaaaaacgtttcgggtttactacgtttaccggacccggtccgggttaccggggtaaccccggg

SEQ ID NO: 424969 - DNA, 745 bp, Homo sapiens
  misc_feature: GZ8MTXP02JF5O1.44.27.C05.1.454.CMB.2.raw
  modified_base (386)..(386): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctggggttttcctcgttgccctcttaagaggtgtcatgtgtcaggtgcaattcgtggagtcgtgggggaggcgtggccccaggtagggggtccctgagactctcctgtgcagcctctggattcaccttcgataatggaatatgcagtggtccgcaggctccgaggcgagggctgggagtggggtgcagggtgtgtctatttccgagtgggaaggaaatcgaaagttcgtacggggtntaagttcccggttaggacgggggtccgtaaatttccgaacccacttacccgtacccgaaggaacgaaaccgtaaactttacccggaaacgaaaccaaccgtaggtacgtttaccgtaccttaactaaaacgttaggaaaacctacggtacccctagggaaccgtaacccgttaccgaacgggaaacccgtaaccgggtacccggttacggtttaacgtttttcgggtacggtaaccggtaaacggtaaccggttaacttacccgtttacgttttaacccgttaaaaacgttccggtttaaccgttaacgttttacccgggaaacccggttccccgggttacgggggtaaacccccgggg

SEQ ID NO: 424970 - DNA, 709 bp, Homo sapiens
  misc_feature: GZ8MTXP02FX2DU.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtgggtccgccaggctccgaggcgaggggctgggagtggggtggcaggtgtgtctatttccagtgggagaaatcaaagtcgtacgggtgaagtttcccggttgacggggtcccgtaatttcccgaacccgtaacttccctacccgaagacgtaaaccgtaaacgtttcccggaaagaaaccaaccgtaagtacgttaccttacctttaaccaaaaagttacggtaaaacctaacgggacccttacggaacgtaacccgttaccgaacgggaaccgaaccgggtcccggttaggtttaacgtttttggtcggtacggtaacgtaccgttaacgtttccttacggttttaacccaaaaacgtttccggtttacctaacggtttccggaaccggtcccggtacgggggtaaccccgg

SEQ ID NO: 424971 - DNA, 542 bp, Homo sapiens
  misc_feature: GZ8MTXP02FWD1P.44.27.C05.1.454.CMB.2.raw
  modified_base (301)..(301): a, c, t, g, unknown or other
  modified_base (372)..(372): a, c, t, g, unknown or other
  modified_base (398)..(398): a, c, t, g, unknown or other
  modified_base (413)..(413): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccncaggctccgaggcgaggggctgggagtgggtggcgaggtgtgtcatttcatggaagaatcaagtctaggtnattccgtgagggcattcacatctcanagacatcgagaacanagtgtctctacaaatgaacagacctagacgacctacgacggacgacggccgttagttacgttttgtgtcgagtactagtctcgtttaccaaaagttcggttactacttcgaacgccgtacggggacccg

SEQ ID NO: 424972 - DNA, 588 bp, Homo sapiens
  misc_feature: GZ8MTXP02JUYUJ.44.27.C05.1.454.CMB.2.raw
  modified_base (189)..(189): a, c, t, g, unknown or other
  modified_base (223)..(223): a, c, t, g, unknown or other
  modified_base (283)..(283): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctcctggtatcaacatcatccaggtaaacnccccaaatcatcatctatgagcctataagacgccctgtagggtttctaatcgcttcacctcgcctaccgaagtcccggacaacgccggcctaccctagaccaatcctcgtgggcctccgagctaggacggacgagctagtatttattacttgttgcttcgaagtcttggttaccgtcgactactactactttatcgtttacgtacgggaagttcggggaaacctagggtacctaaccggtaccgttacggtccaaccgacccgaacggaccccaacccgtactcgtacctaccgtcgtttccccg

SEQ ID NO: 424973 - DNA, 760 bp, Homo sapiens
  misc_feature: GZ8MTXP02G8R5W.44.27.C05.1.454.CMB.2.raw
  modified_base (300)..(300): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcggtggagtcgtgggggaggcggtcggccccaggtacggggggtccctggagactctccgtgtgcagcctgtggacttcaccttcgaataattggaatntgcgtagtcgggtcccgcgaggccgtccgaggccggaggggctgggaggtggggtggcgagggtgtgtctatttccgagtggaaggaaatcgaaagttcgtacgggtgtacgtttcccggttggacggggtccctaattcccaaccgtacttccgtaccgaagtaacgtaacctaaacgttacccggaacgtaaaccgaacgtaacgttacggttacctttaccgttaaaccaaaagttacgaaaaccgtacggtacccgttacggaaccgtaacccgttaacggaacggaaccggtaaaccgggtcccggtttaacggttttaacggtttttgggtacggttaaccggtaaaggtaacctttacgttaccgtttaaccgttttaaacccgtaaaacgtttccgggtttaacctaacggtttcccggaaacccggttcccggtacggggtaaaccccggg

SEQ ID NO: 424974 - DNA, 631 bp, Homo sapiens
  misc_feature: GZ8MTXP02GWR08.44.27.C05.1.454.CMB.2.raw
  modified_base (301)..(301): a, c, t, g, unknown or other
  modified_base (340)..(340): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataattggatatgcaggtggtccncaggctccgaggcgaggggctggagtggggtgcagggtntgtctatttccgagtggaaggtaaatcgaaaggtctacgggtgtacttccggttagacgggtccgtattccgacctactacctaccgagacgaactaacgttccgaagaacaacgtagtcgtacttacttacaaattagaaacacggtacctagacgaccgtacgaacggtaccgaccgggtccgttagtttacgttttagtcggtaccggtagtacttacgttacttacggtttaaccctaaaagttccggttactacgttaccggaccgtccggttacggggaccccgg

SEQ ID NO: 424975 - DNA, 544 bp, Homo sapiens
  misc_feature: GZ8MTXP02JD4BS.44.27.C05.1.454.CMB.2.raw
  modified_base (417)..(417): a, c, t, g, unknown or other
  modified_base (483)..(483): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtggtccgcaggctccaggcgaggggctggagtggggtggcgaggtgtgtcatttccatggagaaatcaagtctcggtgagttccgtgagggccgtattcaccatctcagagacaattccganaacacagtgtctacttacgaaatgaacagcctagacgactcgaggacacggcgtcgttattttggngcgagtacttactcttgtttaccaaaagtcgttactacttcgacgtccgtcgggtacccgg

SEQ ID NO: 424976 - DNA, 603 bp, Homo sapiens
  misc_feature: GZ8MTXP02I8BYV.44.27.C05.1.454.CMB.2.raw
  modified_base (290)..(290): a, c, t, g, unknown or other
  modified_base (300)..(300): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtacgggggtccctgagactctcctgtgcagcctctggattcacttgataatggaatngcagtggccnccaggctcgaggcgaggggctgggagtggggtgcgaggtgtgtctatttcagtggaagaatcgaaagtctacgggtgtactttccggtagacggggtcctattcgacctactcctccagagacaacttaccgaagaacacagtgtactacttacaatacgaacagaccctagacgaccgtacgacggaaccgacgggtccgttaggttaacgttttggtacgtacggtaacggtacttaacgtcttacggtttaacctaaaacgttccggttactacgtttacggaccgtccggttaccgggg

SEQ ID NO: 424977 - DNA, 602 bp, Homo sapiens
  misc_feature: GZ8MTXP02IJGAB.44.27.C05.1.454.CMB.2.raw
  modified_base (300)..(300): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataatggaatatgcagtggtccncaggctccgaggcgaggggctgggagtggggtggcgagggtgtgtcagtttccagtggaaggaaatcgaaagtctacgggtgtaagtttccggttgaggggtccgtattccaccatcctaccagacgactaattccgaagaacacagtagtcttacttacaaatcgaaacagacctagacgacctcgaaggaccacgggtccgttagtttacgttttggcggtacgtagtaacttacttcgttacgtttaaccaaaagttccggtttacgtacgttacggaccgtccggtcgggggacccgg

SEQ ID NO: 424978 - DNA, 516 bp, Homo sapiens
  misc_feature: GZ8MTXP02I2D2L.44.27.C05.1.454.CMB.2.raw
  modified_base (188)..(188): a, c, t, g, unknown or other
  modified_base (222)..(222): a, c, t, g, unknown or other
  modified_base (234)..(234): a, c, t, g, unknown or other
  modified_base (314)..(314): a, c, t, g, unknown or other
  modified_base (357)..(357): a, c, t, g, unknown or other
  modified_base (372)..(372): a, c, t, g, unknown or other
  modified_base (403)..(403): a, c, t, g, unknown or other
  modified_base (437)..(437): a, c, t, g, unknown or other
  modified_base (447)..(447): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaactttgtctcctggtatcaacatcatccaggtaaacgccccaaatcatcatctatgaggcctataagnggccctcagggtttctaatcgcttcacctgcctcagtcgcacncgcctcctgacatcnctggctcagctgagacgaggctgattatacngcagtctcatactacgaagtcggaactactttanaacgttcggntcgaagggaacccagactcgaaccgtctaggtccacgcccaaggctcgccccctggtccacgtcttccg

SEQ ID NO: 424979 - DNA, 588 bp, Homo sapiens
  misc_feature: GZ8MTXP02H56ZC.44.27.C05.1.454.CMB.2.raw
  modified_base (300)..(300): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataatggaatatgcagtgggtccncaggctccgaggcgaggggctgggagtggggtggcaggtgtgtcatttccagtggagaatcaagttctacgggtgtaatttccggttgacggggccgatttccaccctatcctccagacgacaattccgaagaacacagtgtctcttacaaatgaactacgacctagacgacctcgaacggacgaaccggtccgttgttacttttggtagtcgacgtacttactcgttacgtttaccgtaaaacgttcggttactacgttaccggtaccgtccggtacggggacccgg

SEQ ID NO: 424980 - DNA, 665 bp, Homo sapiens
  misc_feature: GZ8MTXP02GH1A5.44.27.C05.1.454.CMB.2.raw
  modified_base (286)..(286): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccnccaggctccgaggcggaggggctgggagtggggtggcgagggtgtgtcatttcagtggagaaatcaaagtctacggtgattccggtggacgggccgtattccgaccatccgtaccagtacgaactaattaccgaagaaacacgagtacgtctactacaaatagaacacgaccgtagacgacctacgacggaccgaccgggtacccgttagtttacgtttttggtacggtaccggtaagtaccttaactttacgttacgttttaacccgtaaaaagtttccggtttaactacgtttaccgaccggtacccggttacgggggaacccgtaacggggtaaccccgttacggtacccgtacccggttccttacccgtccccgg

SEQ ID NO: 424981 - DNA, 535 bp, Homo sapiens
  misc_feature: GZ8MTXP02FOFFR.44.27.C05.1.454.CMB.2.raw
  modified_base (188)..(188): a, c, t, g, unknown or other
  modified_base (358)..(358): a, c, t, g, unknown or other
  modified_base (409)..(409): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccaggtaaacgcccccaaatcatcatctatgagcctaatagagccctcgagggtttctaatcgcttcactgcctcacgtccgcaacncgcctcctgacatctctgggctcagctgagacgagctgattatatgtgctnagtatgttacgtcgcatctatttatgttcgttacgggaagtcgggaccaaaggtccaacggttcctaggtaccaacgtccccgaaaggcccccaaaacccgtcgtacgtaccacctcctttccccg

SEQ ID NO: 424982 - DNA, 579 bp, Homo sapiens
  misc_feature: GZ8MTXP02H5CWY.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatatgcagtgggtccgcaggctccgaggcgaggggctgggagtggggtggcgagggtgtgtcatttccagtggaaggaaatcaagtctacgggtgtattccgttgacgggccgattccaccatctaccagagacaattccgagaacacagtcgtctcttacaaattagaacagacctagaacgacctacgacggaccgacggtccgtagttattttaggtgtacgagtacttactacttacgtttacctaaaagttcgttactacgttcgaccgtccgtcggggtacccgg

SEQ ID NO: 424983 - DNA, 668 bp, Homo sapiens
  misc_feature: GZ8MTXP02JA912.44.27.C05.1.454.CMB.2.raw
  modified_base (303)..(303): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtggtttcctcgttgccctcttaagaggtgtcatgtgtcaggtgcaattcgtggagtcgtgggggaggcgtggccccaggtagggggtccctgagactctcctgtgcagcctctggattcaccttgataattggaatatgcagtggtccnccaggctccgaggcgaggggctggagtgggtggcaggtgtgtcatttcgatggaaggaatcgaaagtcgtacggtgtacgtttccgtaggacggggccctattaccacctaacttcctacccgaagaacggaaacctaaactttaccccggaaaggaaaccaaccaaacggttggttaccttacctttaaccaaaagttacggaaacctaacggcccttaggacggtaacccacgaacggaccgaacgggtcccgttacggttacgttttttgggtacggtacgtacgtaccgttacgttacgttacgttaaccgtaaacgttaccggttacgtacgttaccggtacccggtaccggtaccgggg

SEQ ID NO: 424984 - DNA, 652 bp, Homo sapiens
  misc_feature: GZ8MTXP02FKPKF.44.27.C05.1.454.CMB.2.raw
  modified_base (270)..(270): a, c, t, g, unknown or other
  modified_base (343)..(343): a, c, t, g, unknown or other
  modified_base (392)..(392): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccagggtacggggggtccctgagactctcctgtgcagcctntggattcaccttcgataattggaatatgcaggtgggtccgccaggctccgaggcgaggggctgggagtggggnggcgtaggtgtgtctatttcagtggaagaaatcgaaagtcgtacgggtnacgtttccggttggacggggtcctaagttccgaaccctatccctaccgaagaacggaactaaacgttcccgaaagaaacccacgtaacggttcgttaccttacgtttaaacaaagttacgaaactacgcctacgaacgaccctacgaacggaccgaccgggtccgttagtttacgttttggaggtcgacgtaacttacttacttacgtttaaaccaaagttcgttactacgttaccggaccgcggttacggggaacccgg

SEQ ID NO: 424985 - DNA, 575 bp, Homo sapiens
  misc_feature: GZ8MTXP02JTQ5V.44.27.C05.1.454.CMB.2.raw
  modified_base (303)..(303): a, c, t, g, unknown or other
  modified_base (383)..(383): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataatggaatatgcagtggtccnccaggctccgaggcgaggggctgggagtggggtggcaggtgtgtcagtttcagtgggaggaaatcaaagtctaacgggtnagtttccgtgacggggccattccgaccatctccagacgactaacttccgaagaacacagtacgtctcttactaaatgaacagcctagacgacctacgacggacacggccgttgttacgttttggtcgtcgacgtacgtactcttagttaacctaaaagttcggttacacgttcgtaccgtccgtaccggggg

SEQ ID NO: 424986 - DNA, 571 bp, Homo sapiens
  misc_feature: GZ8MTXP02JPWFW.44.27.C05.1.454.CMB.2.raw
  modified_base (222)..(222): a, c, t, g, unknown or other
  modified_base (281)..(281): a, c, t, g, unknown or other
  modified_base (318)..(318): a, c, t, g, unknown or other
  modified_base (355)..(355): a, c, t, g, unknown or other
  modified_base (363)..(363): a, c, t, g, unknown or other
  modified_base (371)..(371): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctctgtatcaacatcatccaggtaaacnccccaaatcatcatctatgagcctataagaggccctnagggtttcaatcgcttcacctgcctcaagtcgacacncgcctccnacatctcnggctcgagctgagacgagctgtattattattgttagcttacgagtagttgttccgttcgactattacctaactttactcggttacgtttacgggaaggttcgggaaccgtaaagggtccgtacccgttacgtacggtaccaaccggaccccgaaacggtcccccaaaaccccgtacgtacgtaccaccttccgttccccg

SEQ ID NO: 424987 - DNA, 736 bp, Homo sapiens
  misc_feature: GZ8MTXP02H4SR8.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctggagactctcctgtacagcctctggacttcaccttcgaataattggaaatatgcagtggtccgcaggctccgaggcgaggggctggaggtgggtggcaggtgtgtcatttcgagtggaaggaaatcgaaagtcgtacgggtgtagtttcccggtaggacggggtacccgtattaccaaccctactcccgtaccgaagaacgaaacgtaaacttacccggaaacgaaaccaacgtaacgttcgttaccgttactttaaccaaaaagttacgaaaaccaacgtaccgttagaacgaacccgttacgaacggtaacccgaaccggtacccggtttacggtttaacgtttttttggacggttaccgtaaacggtaccttaaagtttacccgttacgtttttaaacccgtaaaaacgtttccgggttttaaccctaacgttttacccgggaaacccggtccccggtttaccgggggtacccgtaaaacccccggggg

SEQ ID NO: 424988 - DNA, 657 bp, Homo sapiens
  misc_feature: GZ8MTXP02GIOR8.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccncaggctccgaggcgaggggctgggagtgggtggcgaggtgtgtctatttcagtggaagaaatcgaaagttctacgggtgtaactttccggttaggacggggcccgtaatttcccaaccctatcctacccgaagaacgaactaaacttacccgaagaaacaacgaagtcgttaccttacttacaaaacgtagaaacacggacctacgacgaacctacgaacggaccgaaccgggtccgttagtttaacgtttttggtacggtacgtaagtaccttattccgttaacggtttaacctaaaacgtttccggttactaacgtttaccggaaccggtcccggttacggggaaccccggg

SEQ ID NO: 424989 - DNA, 525 bp, Homo sapiens
  misc_feature: GZ8MTXP02H3TE6.44.27.C05.1.454.CMB.2.raw
  modified_base (301)..(301): a, c, t, g, unknown or other
  modified_base (484)..(484): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctccaggcgaggggctgggagtggggtggcaggtgtgcatttcatggaggaaatcgaagttctcggtgattccggttgaggggcccattccaccatctccagagacaattccgagaacacgctgtatctagactaaaatgaacagccctagagagcgaggacacggctgtagtattacnggtcgcgaggacataagttgacgtactacacctgactacgg

SEQ ID NO: 424990 - DNA, 566 bp, Homo sapiens
  misc_feature: GZ8MTXP02ILZVY.44.27.C05.1.454.CMB.2.raw
  modified_base (428)..(428): a, c, t, g, unknown or other
  modified_base (437)..(437): a, c, t, g, unknown or other
  modified_base (467)..(467): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgcaggctccaggcgaggggctggaggtgggtggcagggtgtgtcatttccagtggagaaatcaagtctagggtgagttccggttgggcggtacgtctaccactctcctacaggacaactactcgaanacagtagtntactctaacatacgacacgtcgagactacngaacgcgacgtcgtattttacgttgcgacgtatacttacttacgttccttaaactaacgttcgttactacgtaccggaccgtcgggtaccggacccggg

SEQ ID NO: 424991 - DNA, 798 bp, Homo sapiens
  misc_feature: GZ8MTXP02HZUM6.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccgcaggctcgaggcgaggggctgggagtgggtggcgagggtgtgtcatttccagttgggaaggaaatcgaaaggttctacggggttgaagtttcccggttaggaacgggggtcccgtaattttcccgaaccctaacttcccgtacccaacggaacggtaaaccctaaaacgtttaccccggaaacggtaaaaccaaccgtaacgttacggttacctttaccgtttaacctaaaacgtttaacggtaaaacccgaacggtaccccgttacggaaaccggtaaaccccttaccggaaaccggggaacccgtaaacccggggtccccgggtttaaggttttaaccggttttttaggtttacgggtaaccggtaacgggttaaaccctttaacgtttaccgtttaaccggtttttaaacccgtaaaaaacgtttcccggggttttaacctaacgtttacccggtaaacccggttcccggtttacgggggtaacccccgggg

SEQ ID NO: 424992 - DNA, 614 bp, Homo sapiens
  misc_feature: GZ8MTXP02HFHHX.44.27.C05.1.454.CMB.2.raw
  modified_base (336)..(336): a, c, t, g, unknown or other
  modified_base (382)..(382): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctgtggattcaccttcgataattggaatatgcagtggtccgcaggctccgaggcgaggggctgggaggtggggnggcgaggtgtgtctatttccagtggagaaatcgaagttctcgggtntacgttccggttgacgggtccgattccacctatcctccagacgactaattaccgagaacactagtcgtaccttcttaacaaattgaaacacgacctaggaacgtaccctacgacggaccgtaccgggtaccgttgtttacgttttagtcggacgtaacgtacttacgttacgttacgtttaaccaaaacgttccggttactacgttaccgaccggccggtacgggtacccgg

SEQ ID NO: 424993 - DNA, 523 bp, Homo sapiens
  misc_feature: GZ8MTXP02GB0RL.44.27.C05.1.454.CMB.2.raw
  modified_base (188)..(188): a, c, t, g, unknown or other
  modified_base (282)..(282): a, c, t, g, unknown or other
  modified_base (319)..(319): a, c, t, g, unknown or other
  modified_base (359)..(359): a, c, t, g, unknown or other
  modified_base (414)..(414): a, c, t, g, unknown or other
  modified_base (507)..(507): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatattcttagtcttaactttgtctcctggtatcaacatcatccaggtaaacnccccaaatcatcatctatgagcctataagaggccctnaggggtttcaatcgcttcacctgcctcaagtccgacaacncggcctcctgacaatctctgggctccagctgagcgagctgattatattgtgctanagtatgttcgtcgctatcactttatgtacgttcggaagttcgggacctaaaggtccaaccgttctagggtccagacccaaaggcccaaacccnctcgtacactctcccg

SEQ ID NO: 424994 - DNA, 592 bp, Homo sapiens
  misc_feature: GZ8MTXP02HUA18.44.27.C05.1.454.CMB.2.raw
  modified_base (222)..(222): a, c, t, g, unknown or other
  modified_base (234)..(234): a, c, t, g, unknown or other
  modified_base (362)..(362): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatnttcttagtcttaacttgtctcctgtatcaacatcatccaagtaaacgcccccaaatcatcatctatgagcctaataagacggccctgagggtttctaatcgcttcacctgcctcaacgtcgaccaacnccggcctccctagacctaatctctcgggctaccgaggctggaggacgaggcttaggtaatttattagttgttgtccttacaaggttattggtttacgtccgatacttctaacttattggttcttacgggaagttcggggaacctaaggtcctaaaccggttcctaacgggtccaacggtacccgaaacggccccaaaaccccgtactacgtaccacgtttccttacccgg

SEQ ID NO: 424995 - DNA, 750 bp, Homo sapiens
  misc_feature: GZ8MTXP02HDL3W.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtgggtccgcaggctccgaggcgaggggctggaggtggggtggcgaggtgtgtctatttcagtggaaggaaatcgaaagtctacgggtgtacgtttccggttggacggggtcccgtaatttcccgaaccctacttacccttacccgaaggtaacgaaccgtaaaacgtttacccgaaacggtaaaaccgaacgtaaacggttacgttaccgttacctttaaaccgtaaaatttacgaaaaccgtaacggtaccccgttaaggaaccgtaaaccccgttaccggaaaacgggaacccgtaaccggggtacccggttacggttttaaacgtttttggttacggtaccggtaaggtaaccgtttaaacgttccgttaacgttttaaacccgtaaaaagtttccgggttaactaccggtttaccggaacccggtcccggtttacgggggtaacccccggg

SEQ ID NO: 424996 - DNA, 512 bp, Homo sapiens
  misc_feature: GZ8MTXP02FHRNW.44.27.C05.1.454.CMB.2.raw
  modified_base (363)..(363): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaagcccccaaactcatcatctatgagcctataagaggccctcaggggtttctaaatcgcttcacctgcctcaagtccggcaacncggcctccctgacaatctctgggctccaggctgaggacgaggctgattattattgttgctcagatgttcgtgcatcacttatgtcttcggaagtgggacaaggtcaccgtcaggtcagcccaaggccaaccccactcgtacactctccg

SEQ ID NO: 424997 - DNA, 576 bp, Homo sapiens
  misc_feature: GZ8MTXP02F1KEE.44.27.C05.1.454.CMB.2.raw
  modified_base (382)..(382): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgccaggctccgaggcgaggggctgggagtggggtggcgaggtgtgtctatttcagtggagaaatcaaagttctacgggtnacgtttccggtagaggggtcctattccaccatcctaccagagaactaatccgaagaacacagtgtctctacaaatgaacacgacctagacgacctcacggacacggtccgtagttacgttttgagcgtagtacttactacttcgtttaaccaaaacgttcggttactacgttccgacgtccgtacggggacccg

SEQ ID NO: 424998 - DNA, 612 bp, Homo sapiens
  misc_feature: GZ8MTXP02H8UIN.44.27.C05.1.454.CMB.2.raw
  modified_base (268)..(268): a, c, t, g, unknown or other
  modified_base (382)..(382): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctctgtgcagcctcnggattcaccttcgataattggaatatgcagtcggtccgccaggctccgaggcggaggggctggagtggggtgcgaggtgtgtcatttcagtggaagtaatcgaagtctaaggtntacgtttccggtgacgggcctagtaccaccatcctaccgagacgaacaacgttaccgaacgaacacgtagtacgtacttacttactaaacgtagaacgacgaccgtagaaccgacctacgaacggaccgacggtaaccgttgttagtttttggacgtaccgagtaccttacttaccttacgtttaacctaaacgttacggttactacgttccgaccgtccggtaccgggg

SEQ ID NO: 424999 - DNA, 617 bp, Homo sapiens
  misc_feature: GZ8MTXP02IAQ7B.44.27.C05.1.454.CMB.2.raw
  modified_base (303)..(303): a, c, t, g, unknown or other
  modified_base (385)..(385): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccncaggctcgaggcgaggggctgggagtggggtggcagggtgtgtcatttccagtgggaaggaaatcgaaagttctacggggtntagtttcccggttagacgggggcctattccgacctatcctaccagacgactaacttccgaagaacacagtcgtactctttacaaattacgaacacgacctagacgacctcgaacggaccgacgggtccgttagtttacgtttttggtggtacgtacgtacttacgtactttacgtttaccgtaaaagttccggttactacgttccggaccgtccggttacggggaaccccgg

SEQ ID NO: 425000 - DNA, 566 bp, Homo sapiens
  misc_feature: GZ8MTXP02FXJDR.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcagtggtccgcaggctccaggcgaggggctggagtgggtggcgaggtgtgtcatttccagtggagaaatcgaaagttctacgggtgattccggttgaggggtccgattcaccatctccagagacaatccgagaacacagtgtctcttacaaatgaacagcctagagacctcgacggacacggtccgtgttacttttgtgtcgagtactactacttcgtttaacctaaaacgttcggttactacgttaccggaaccgtccggtacggggtaacccgg

SEQ ID NO: 425001 - DNA, 604 bp, Homo sapiens
  misc_feature: GZ8MTXP02HO187.44.27.C05.1.454.CMB.2.raw
  modified_base (316)..(316): a, c, t, g, unknown or other
  modified_base (369)..(369): a, c, t, g, unknown or other
  modified_base (396)..(396): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctggggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgtgagggccattcaccatctccaganacaattccgagaacacagtgtctcttacaaatgaaacagcctagacgaccttnaggaccacggccgttgttatttttggngcgagtactatcttagtttacctaaaagttcggttactattcgacgtccgtggggccacggggaacctggtccaccgtctccgtccggccctccaccgaacgggcccacgttccggtcccttcccccgtcggcccgtcccctcggccctcccgacgggccgacccgtaacccgtccggacgacgaccaccgacggcccgggtccccgg

SEQ ID NO: 425002 - DNA, 752 bp, Homo sapiens
  misc_feature: GZ8MTXP02GTECE.44.27.C05.1.454.CMB.2.raw
  modified_base (168)..(168): a, c, t, g, unknown or other
  modified_base (264)..(264): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttggctgagctgggtttcctcgttgccctnttaagaggtgtcatgtgtcgaggtgcaattcgtggagtcgtgggggagcggtggccccgaggtacgggggtccctgagactctcctgtgcagcctnggattcaccttcgataattggaatatgcagtggccgcaggctcgaggcgagggctgggagtggggtgcgtagggtgtcgtcgtatttccgaagttgggaaaggtaaaattcgaaagttcgtacgggtgtaactttcccgggttagacggggtccctaagttccaacccgtattacccgtacccgaagaacgaaaccgtaaacgttacccggaaacgaaaaccgtaaccgtaagtcggttaccttaccgtttaaactaaaacgttacgaaaacgaaccggtaccccgtaaacggaaccgtaacccgtaaccggaaccgggaaccgtaacccggggtacccggttaacggttttaacggtttttaccggttgggtaccgtaacgggttaaccgttactttaccgttaacgtttaaacccgtaaaaacgtttccgggttaacttaacggtttacccggaacccggtcccggttacgggggtaaaccccggg

SEQ ID NO: 425003 - DNA, 804 bp, Homo sapiens
  misc_feature: GZ8MTXP02F6PCU.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccgcaggctccgaggcgaggggctgggagtggggtggcgaggtgtgtcatttccgagtgggaaggaaatcgaaaggttcgtacggggttgacgtttcccggttaggacgggggtcccgtagtttacccaacccgtattcccgtacccgtaaggaacgtaaaccctaaacgtttaccccggaaacgaaaacccgtaaccgtaacggttacggttacccctttacctttaaaccgtaaaacgtttacggaaaaccctaacgggtaccccgttaaggaaacccggtaaccccgttaccggaaacggggaaccctaacccgggggttaccccggtttaggtttttaaacgtttttttcgggttacggtaccggtaaacgggttaacctttacgtttaccgtttacggtttttaaaccccgtaaaaaacggttttcccggggttttaaccttaacgtttacccggtaaacccgggttccccgggttaccggggggttaaacccccgggg

SEQ ID NO: 425004 - DNA, 622 bp, Homo sapiens
  misc_feature: GZ8MTXP02IK33A.44.27.C05.1.454.CMB.2.raw
  modified_base (396)..(396): a, c, t, g, unknown or other
  modified_base (449)..(449): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctctgtgcagcctctggattcaccttcgataaattggaatatgcaggtcgggtcccgccgaggctccgaggcggaggggctgggaggtggggtggcgagggtgtgtctatttccgagtgggaaggaaatcgaaagttctacggggtntacgttccggttgacgggggtccatttccaccatctacagagacaattccganaacacagtgtactcttacaaatcgaaacacgacctagacgacctacgaacggacgtaccggtccgttgtttaacgtttttggaggtacgtaagtaacttacttacgtttacgtttaacctaaaacgttccggtttactacgtttacggaccgtccggtacgggggtaacccgg

SEQ ID NO: 425005 - DNA, 802 bp, Homo sapiens
  misc_feature: GZ8MTXP02HKS69.44.27.C05.1.454.CMB.2.raw
  modified_base (271)..(271): a, c, t, g, unknown or other
  modified_base (283)..(283): a, c, t, g, unknown or other
  modified_base (324)..(324): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctctggattcacttcgataatgaatngcagtcggtccnccaggctccgaggcgaggggctggagtggggtgcgaggtgngtctatttcgagtggaaggtaaatcgaaagtcgtacggtgtactttccggtaggacgggtcctattccgaaccctattccctacccgaagtaacggaacctaaaacgtttacccggaaagaaaacccgaacgtaacggttacggttaccctttaaacgttacctaaaaacgttacggtaaaaccacggtacccttacggaaaccggtaaaccccttacggaaacgggaacccggtaacccggggttaccccggttacggttttaaacgttttttggtacggtaccggtaacggttaactttaacgtttaccgtttaacggttttaaaacccgttaaaaacgtttcccgggtttaaccttaaacggttttacccggaacccggtcccggttacgggggaaccccgtaaaccgggggtaaaccccgtttaccggggtaaacccgttaccccggtttacccgtccccggtttaacccccgg

SEQ ID NO: 425006 - DNA, 538 bp, Homo sapiens
  misc_feature: GZ8MTXP02FRXW5.44.27.C05.1.454.CMB.2.raw
  modified_base (479)..(479): a, c, t, g, unknown or other
  modified_base (538)..(538): a, c, t, g, unknown or other
tcagacagtatatacacgaccggtgctcgatttagacgcgatcgaagggtttggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggttcattccgacgcctggggccagggaccctggtcaccgtctcctcggcctccaccaagggcccatccggtcttccccctggccgcccctgcctccaggacgcacctccgagagccacagccgaccctgggctgcccnggtcaaggctacttccgtatactactgtcctgacgcggggctggcaacggcgcagtagn

SEQ ID NO: 425007 - DNA, 587 bp, Homo sapiens
  misc_feature: GZ8MTXP02FUYW3.44.27.C05.1.454.CMB.2.raw
  modified_base (402)..(402): a, c, t, g, unknown or other
  modified_base (405)..(405): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataatggaatatgcagtgggtccgccaggctccgaggcgaggggctgggagtgggtggcgaggtgtgtctatttccgagtggaagaatcaagtctacgggtgatttccgtgagggctattcaccntcncagagacaattccgaagaacacagtcgtactcttacaaatgaactacgcctagacgacctacgacggacgaacggtccgttagttacgttttggcgtacgtacgtaacttactacgttacgtttaccctaaaagttcggtttactaacgttccggtaacgtcccggtacggggtaaccccgg

SEQ ID NO: 425008 - DNA, 590 bp, Homo sapiens
  misc_feature: GZ8MTXP02FHAYM.44.27.C05.1.454.CMB.2.raw
  modified_base (373)..(373): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctcctggtatcaacatcatccaggtaaacgcccccaaactcatcatctatgaggcctaataagacggccctcgaggggtttactaagtcgtcttcacctgcctcaacgtccggacaacnccgccctaccctgacaatctctgggctcagctgaggacgaggctgattattattgttgctcagtatgttcgtcgactatcactttagtgtacgtttacgggaaagttcgggaacctaagggtcctaacccggttaccgttaacggtaccgaacggacccccgaaacgggaccccaaaacccccgtacgtacgtaccctaaccttccgtttacccccg

SEQ ID NO: 425009 - DNA, 622 bp, Homo sapiens
  misc_feature: GZ8MTXP02I44VO.44.27.C05.1.454.CMB.2.raw
  modified_base (189)..(189): a, c, t, g, unknown or other
  modified_base (221)..(221): a, c, t, g, unknown or other
  modified_base (266)..(266): a, c, t, g, unknown or other
  modified_base (279)..(279): a, c, t, g, unknown or other
  modified_base (493)..(493): a, c, t, g, unknown or other
tcagacagtatatacacgaccggtgctcgatttagacgcgatcgaagggtttggggggtcacaaagaggcagcgctctcgggacgtctccaccatggcctgggctctgctgctcctcactctcctcacccaggacacagggtcctgggcccagtctgccctgactcagcctgcctccgtgtctgggtcncctggacagtcgcaccatctcctgcactgganccagcgtaatattcttagtcttaactttgtctcctggtatcaacntcatccagtaacnccccaaatcatcatctatgacggtacctataagacggacccctgtaggggtttctaagtccgtcttccacctcgccctaccaaacgtccgccaaccgccgggtccctccctacgacctaatctcgtcgggtccctccgaggtctaggaggacgaggctaggtaatttattagttgttagcttacagtagtcgttcgtcgactagttcctatttntacggttcgttacgggtaacgtcggggtaacctaaagggtccctaccggttacctacggggtaccaaccggtacccgaaacggccccctaaaaccccgtcgttaccgtacctaaccgttctttcccccg

SEQ ID NO: 425010 - DNA, 594 bp, Homo sapiens
  misc_feature: GZ8MTXP02H2LLY.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtcccgccaggctccgaggcgaggggctgggagtggggtggcaggtgtgtctatttccgatgggaagaaatcgaaagttctcgggtgacgtttccggtgagggggcccaattccgacctatcctaccgagacgaactaaacgttcccgaaagaaccgacagtgtactcttacaaattgaacacgacctgacgacctcaggacacggtcgtgtttaacgttttgtcgtacgagtacttactcttacgtttacccaaaagttcgttactacgtttcgaccgccgttacggggacccgg

SEQ ID NO: 425011 - DNA, 539 bp, Homo sapiens
  misc_feature: GZ8MTXP02GFGLN.44.27.C05.1.454.CMB.2.raw
  modified_base (189)..(189): a, c, t, g, unknown or other
  modified_base (223)..(223): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaaatattcttagtcttaactttgtctctggtaccaacatcatccaggtaaacgcccccaaactcaatcatctatgaggcctataagaggccctcaggggtttctaatcgtctcactcgcctccaagtccgcaacacggccctccctgacatctcgtggctccgagtctgaggcgagctagatttattattgtgctcagtattgtactcgcatctaacttattgtcttacgggaagtcgggaacaggtctaccggtctacggtcaacgcccaaaggcccaaccccgatcgtacactcctcgtttccccc

SEQ ID NO: 425012 - DNA, 584 bp, Homo sapiens
  misc_feature: GZ8MTXP02GA3OH.44.27.C05.1.454.CMB.2.raw
  modified_base (447)..(447): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccgccaggctccaggcgaggggctggagtggggtggcgaggtgtgtctattccatggaggaaatcaagtctacgggtgagttcccgttgacggggccgattcaccgatcctcccgaagagacaattccgaagaacacagtgtctctanaaatgaacacgctgagacctcgaggacacggccgtagttacgttttggagccgtaaggacttactacgttcgtttaacccgaaaagttcccgggtttactaacttccggtaccgtccggttacgggggtaaccccgg

SEQ ID NO: 425013 - DNA, 581 bp, Homo sapiens
  misc_feature: GZ8MTXP02JKD1X.44.27.C05.1.454.CMB.2.raw
  modified_base (377)..(377): a, c, t, g, unknown or other
  modified_base (401)..(401): a, c, t, g, unknown or other
  modified_base (424)..(424): a, c, t, g, unknown or other
  modified_base (437)..(437): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtgggtccgcaggctccgaggcgaggggctgggaggtgggtggcaggtgtgtcatttcagtggaggaaatcaagtctacgggtnagttccgtgagggcctattcaccntctccagagacatccgagaacanagtgtactcttanaaattgaacagacctgacgacctcgacggacaacggtccgtagttacgttttggtcgtacgtaggtacttactacgttacggtttaaccaaaagttccgggtttactacgtttaccggaaccgtccggtacgggggtaaccccg

SEQ ID NO: 425014 - DNA, 581 bp, Homo sapiens
  misc_feature: GZ8MTXP02GD494.44.27.C05.1.454.CMB.2.raw
  modified_base (304)..(304): a, c, t, g, unknown or other
  modified_base (383)..(383): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtcgggtccnccaggctccgaggcggaggggctgggagtggggtggcgaggtgtgtctatttcgagtggagtaaatcaagtctagggtnacgttccggtgagggcctattccacatctcagagactaatccgagaacacagtgtactctacaatagaacacgacctacgacgacctacgacggacgacggtccgtagttacgttttgtgtacgtacgtacgttactacgttacgtttaacctaaaagttcgttactacgttaccgaccgtccggtacgggtacccgg

SEQ ID NO: 425015 - DNA, 525 bp, Homo sapiens
  misc_feature: GZ8MTXP02JVMYA.44.27.C05.1.454.CMB.2.raw
  modified_base (476)..(476): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgcaggctccgaggcgaggggctgggagtggggtggcagggtgtgtcatttcatggagaaatcaagtctacggtgattccgtgagggccattcacatctcagagacaatccgagaacacagtgtactcttacaaatgaacagcctagagacctcaggacacggccgtgtactttgngcgagactatctgttacaaaagtcgttacacttcgacgccgtgggaccg

SEQ ID NO: 425016 - DNA, 763 bp, Homo sapiens
  misc_feature: GZ8MTXP02HK86W.44.27.C05.1.454.CMB.2.raw
  modified_base (377)..(377): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggatcaccttccataatggatatgcagtgggtccgcaggctccgaggcgaggggctgggagtggggtggcgaggtgtgtctatttccagtggagaaatcaagtctacgggtnacgtttccgttaggacgggggtcccgtatttacccgacccgtaacttacccgttacccgacggaacggtaaaccctaaaacgtttaccccggaaacggaaaacccgtaaaccgtaaacggttcgttaccgtttaccgtttaaacctaaaagtttacggaaaacctaacgggtacccttacggaaacggtaaccccgttaccgaaaccggggaccgtaacccgggggtacccgttaaggttttaccggttttttaggttacgggtaccggtaacggttaaccttaacgtttacccgtttacgttttaaacccgttaaaaacgttcccgggtttaaccttacgttacccggtaacccgtcccggggtttaccgggggtaacccccggg

SEQ ID NO: 425017 - DNA, 519 bp, Homo sapiens
  misc_feature: GZ8MTXP02FTK8J.44.27.C05.1.454.CMB.2.raw
  modified_base (186)..(186): a, c, t, g, unknown or other
  modified_base (318)..(318): a, c, t, g, unknown or other
  modified_base (357)..(357): a, c, t, g, unknown or other
  modified_base (363)..(363): a, c, t, g, unknown or other
  modified_base (367)..(367): a, c, t, g, unknown or other
  modified_base (416)..(416): a, c, t, g, unknown or other
  modified_base (511)..(511): a, c, t, g, unknown or other
tcagacagtatatacacgaccggtgctcgatttagacgcgatcgaagggtttggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaactttgtctcctggtatcaacatcatccaggtaaagcccccaaactcatcatctatgagcctataagagccctnaggggtttctaatcgcttcacctgcctcaagtcgcaacncggccncctnacatctctggctcgagcgtagaggacgagctagattattattgttgctnagtatgttcgtctcaatcactttatcgttagttacggaaggtcggaacaggttcaccgtcgtacggtacacgaccaacgcccaaccactgctacnctttcccg

SEQ ID NO: 425018 - DNA, 595 bp, Homo sapiens
  misc_feature: GZ8MTXP02G96SH.44.27.C05.1.454.CMB.2.raw
  modified_base (189)..(189): a, c, t, g, unknown or other
  modified_base (236)..(236): a, c, t, g, unknown or other
  modified_base (363)..(363): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcactggagccagcggtaatnttcttagtctttaacttgtctcctggtatcaacatcatccagtaaacgccccaaactcatcatctatgagcctataagacgccctcaggggtttctaatcgcttcactgcctcaagtccggacaacncggcctcctgacatctctggctcagctgaggacgagctgattattattgttagctcagtatgtttacgcgactatactaactttatcggttacttacgggaagttcggggaccctaaaagggttccgaacccggtttaccgtaacggttacccgaacggtcccccgtaaaacggggacccccctaaaacccccgtacgttaccggtacccctaaccttcccgtttaaccccg

SEQ ID NO: 425019 - DNA, 784 bp, Homo sapiens
  misc_feature: GZ8MTXP02HTEY9.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtgggtcccgcaggctccgaggcggaggggctgggagtggggtggcgagggtgtgtctagtttccgagtaggaaggaaattcgaaaaggttcgtacggggttgtaacgtttcccgggttagtaacgggggtccctaaagtttcccgaaaccctaaactacccttacccgaaaggaacgtaaacccgtaaaacgtttacccggaaacggaaaaccaaaccgtaacgttacgttacccgttacctttaaacctaaaagttaacggaaaaccctaacggtaccccgttaagggaaccgtaacccgtaaccgaacggggaaaccgtaacccggggtcccggtttacggttttaaacgtttttcgggttacgggtaccggtaaaggtaaccgtttacgttacctttaacggtttaacctaaaaaacggtttccgggtttaaccttacggtttaccggtaacccggtacccgggttccgggggtaaaccccgggg

SEQ ID NO: 425020 - DNA, 593 bp, Homo sapiens
  misc_feature: GZ8MTXP02IW1K0.44.27.C05.1.454.CMB.2.raw
  modified_base (306)..(306): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccaggtaggggggtccctgagactctcctgtgcagcctctggattcaccttcgataattggaatatgcagtcgggtccncaggctccgaggcgaggggctgggagtggggtggcagggtgtgtcatttccagtggaaggaaatcgaagtctacgggtgtactttccggttgacggggcctagttccacctatctccagagactaacttccgaagaacacagtcgtctacttacaaatgaacagacctagacgacctcgaacggacgacggccgttgtttacgttttgtacgtcgtagtacttactacttacgtttacctaaaagtttccggttactaacgttcgaccggtccgtacggggacccgg

SEQ ID NO: 425021 - DNA, 627 bp, Homo sapiens
  misc_feature: GZ8MTXP02IJGS5.44.27.C05.1.454.CMB.2.raw
  modified_base (303)..(303): a, c, t, g, unknown or other
  modified_base (322)..(322): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataaattggaatatgcagtggtcnccaggctccaggcgagggntgggagtgggtggcaggtgtgtcgatttccaatgggaagtaaaatcaaagtctacgggtgatttcccgtagacggggtcccaatttccaaccctaactcttacccaaggaacgaaactaaacgttaccgaaacaaacaacgtagtacgtaccttacttaactaaagtagaaacacgacgtacgacgacctacgacggtaaccgacggtcgttagtttacgttttggtacgacgtaagtactacttacttacgtttaaccgtaaaacgttacgttactacgttaccgaccgtaccgtacgggaccg

SEQ ID NO: 425022 - DNA, 775 bp, Homo sapiens
  misc_feature: GZ8MTXP02I50ZG.44.27.C05.1.454.CMB.2.raw
  modified_base (203)..(203): a, c, t, g, unknown or other
  modified_base (340)..(340): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgnggagtcgtgggggaggcgtggccccgaggtacggggggtccctgagactctcctgtgcagcctctggattcaccttcgattaatggaatatgcagtggtccgcaggctccgaggcgaggggctgggagtggggtgcngggtgtggtctagtttccagtgggaaggaaaacttcgaaaggttctacggggttagaacgttttcccggttaggaacggggggtcccctaaagttttcccgaaaccctaacgttacccgttacccgaaaggaacggtaaacctaaaacgtttacccccggaaaggaaaaccctaacgtaacggttacgtttaccttaccgtttaacctaaaaaagttacggaaaaccaaccggtaccccgttaagaacggaaccccgttaccgaacggggtaaacccgaaccggggttccccggttagggtttaacgttttttgggtacggtaccggtaaaggtaacttacgttaccgtttacgttttaaacccgaaaaagtttcccgggtttactaaacggtttcccggtaaacccggttacccggttcgggggtaaaccccgg

SEQ ID NO: 425023 - DNA, 588 bp, Homo sapiens
  misc_feature: GZ8MTXP02JUQXE.44.27.C05.1.454.CMB.2.raw
  modified_base (285)..(285): a, c, t, g, unknown or other
  modified_base (359)..(359): a, c, t, g, unknown or other
  modified_base (470)..(470): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccnccaggctccgaggcgaggggctggagtggggtggcaggtgtgtcatttcagtggagaaatcaaagtctacggtnattccgtgagggccattccacatccgtcagagacaattccgaagaacacagtgtctcttacaaatgaacagcctagacacctcgacgacgacgggtccgtgttagttttgngtcgtacgactagtcttacgtttacccgtaaaattccggttacacttccggacgtccgtacgggggaacccgtaacggggaaccccttcggtaccgtacccgtccgtcccgtccccgg

SEQ ID NO: 425024 - DNA, 582 bp, Homo sapiens
  misc_feature: GZ8MTXP02FMLC3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataattggaatatgcaggtggtccgccaggctccgaggcgaggggctgggagtggggtgcgaggtgtgtctatttcagtggagaatcaagtctacggtgtacgttccgtgacgggcgtattccaccatctcagagacaatccgaagaacacagtcgtctctacaaatagaacacgcctagacgacctacgaacggaccaccgggtaccgttgtttacgttttggtggtacgtacgtacttacttacgttacgtttactaaaacgttcggttactacgttccgaccggtccggtacgggtaccgg

SEQ ID NO: 425025 - DNA, 646 bp, Homo sapiens
  misc_feature: GZ8MTXP02F4ZJ7.44.27.C05.1.454.CMB.2.raw
  modified_base (301)..(301): a, c, t, g, unknown or other
  modified_base (381)..(381): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaagactcaccatggagtttgggctgagctgggttttcctcgttgccctcttaagaggtgtcatgtgtcaggtgcaattcgtggagtcgtgggggagcgtggccccaggtagggggtccctgagactctctgtgcagcctctggattcaccttcgataattggaatatgcaggtcggtccncgaggctccgaggcgaggggctgggagtggggtgcgaggtgtgtctatttccgagtggaagaaatcaaagtctacgggtnacgtttccggttagacgggggtcctattcccacctactccctaccaagacgtaacgtaaacgttacccgaaagaaaccgaaccgtagtcgttaccttaccttaacaaaacttacgaaacacggtaccctagaacgtaccctacgaacggaccgacggtcccgttagttaagttttcggagacgtacgtaacgttacgttacgttacgtttaaccaaaacgttcgttacctacgtttaccggaccggtccggtacggggaacccgg

SEQ ID NO: 425026 - DNA, 610 bp, Homo sapiens
  misc_feature: GZ8MTXP02JVGKA.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataatggaatatgcagtggtccgccaggctccgaggcggaggggctgggagtggggtgcgaggtgtgtcatttcagtggaaggtaatcgaagtcgtaacgggtgacgtttccgtggacggggtcctagttcacccgtatcctccgagaacgacaattaccgaagaaacacgtaagtgtacctacttacaaatgaacagccctagacgacctacgacggaccgacggtccgttagttacttttggtacgtacgtacgtacttacttaccgtttagtttaaccgtaaaacgtttcggttacttacgtttaccggaccgtcggtcccggggg

SEQ ID NO: 425027 - DNA, 579 bp, Homo sapiens
  misc_feature: GZ8MTXP02JLUXF.44.27.C05.1.454.CMB.2.raw
  modified_base (397)..(397): a, c, t, g, unknown or other
  modified_base (547)..(547): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggagaatcaagtctacggtgatttccgtgaggccattcaccatctccagagacaattccgaagaacacagtgtctcttacaaatcgaaacagcctagacgacctcagggaccacgggtccgttagttatttttggngacgagtacttatcttgttaccaaaagttcgttctattcgacgtccgtcgggaccacgggaacctcggtccaccgtctccgtccggcctccgaccgacggccctacgtccggtcccttccccgtcggcccgcccgtcgcctccgacggcnccaaccgccgacgacgccacgaccgccgcccg

SEQ ID NO: 425028 - DNA, 562 bp, Homo sapiens
  misc_feature: GZ8MTXP02F3F2W.44.27.C05.1.454.CMB.2.raw
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccncaggctccgaggcgaggggctgggagtggggtggcgaggtgtgtcatttccagtggagaaatcaagtcgtacggtgagttccggttgaggggtccgattcaccatctccagagacaattccgagaacacagtgtactcttacaaatagaacagcctacgagacctcgaggacacggtcgtgttacgtttgtgtcgtagtactattactcgtttacctaaaagttccggttactacgttccgacgtccgtcggggacccgg

SEQ ID NO: 425029 - DNA, 553 bp, Homo sapiens
  misc_feature: GZ8MTXP02FF265.44.27.C05.1.454.CMB.2.raw
  modified_base (302)..(302): a, c, t, g, unknown or other
  modified_base (343)..(343): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctctggattcaccttcgataattggaatatgcaggtgggtccnccaggctccaggcgaggggctgggagtggggtggcaggtgngtcatttccatggagaatcgaagtctacggtgatttccgttgagggtccgattcaccatctccagagacaatccgagaacacagtgtctctacaaatagaacacgcctagacgacctacgacggaccgacggtccgttagttacttttggtgcgagacctatctacgtttaccaaaagttcggttacacttcgacgccgtcgggacccgg

SEQ ID NO: 425030 - DNA, 665 bp, Homo sapiens
  misc_feature: GZ8MTXP02HVPM9.44.27.C05.1.454.CMB.2.raw
  modified_base (512)..(512): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttggctgagcttgggttttcctcgttgccctcttaagaggtgtcatgtgtcaggtgcaattcgtggagtcgtgggggagcggtggccccgaggtacgggggtccctggagactctctgtgcagcctctggacttcaccttcgaattaagttggaattagtgacgtaggtcgggtcccgaccgaggcctccgaggggcggacgggggtctggggaggtggggtcggcgtagggtgttaggtactagttttccgaagttaggggaagtaaaacttcgtaaacggttcgtacggggttgtacgtttccggtagacgggctattccactatctacgagagaactaacgtccgaagaacactagtacgtacttactaanaaactagaacacgcctagacgaccgtacgacggacgtacggtccgttagtttacttttacggcgtacgtagttaacttacgttcctttaacgtttaaaccgaaaagtttccggttactaacgtaccgtaccggtccggtacggggtaacccgg

SEQ ID NO: 425031 - DNA, 714 bp, Homo sapiens
  misc_feature: GZ8MTXP02IZ22O.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatatgcaggtggtccgcaggcctccgaggcgaggggctgggagtgggtggcagggtgtgtctatttccgagtggaaggtaaaatcgaaaggttcgtacggggttgtaacgtttcccggttgggaacgggggtcccgtaatttcccaacccgtacttcctacccgaacgaacggaacctaaacgtttacccggaaacgaaaaccgaaaccgtaggttacggttacctttacctttaaccgtaaaatacgtaaaacccacgtacccgtacggaacgtacccgtacgaacgggtaccgacgggtacccggttacgtttaacgtttttggtacggtacggtacgtaacgttacgttacgtttacggtttaacctaaaacgttcggttacttacgttaccggtaccgtcccggttacggggtaaccccgg

SEQ ID NO: 425032 - DNA, 598 bp, Homo sapiens
  misc_feature: GZ8MTXP02GZ88L.44.27.C05.1.454.CMB.2.raw
  modified_base (318)..(318): a, c, t, g, unknown or other
  modified_base (442)..(442): a, c, t, g, unknown or other
  modified_base (458)..(458): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgagggtacggggggtccctggagactctccgtgtgcagcctcgtggacttccaccttcgaattaatggaatatgcaggtcgggtccnccgaggcctccgagggcggaggggctgggaggtggggtggcgagggtgtgtctagtttcgagtgggaagaaatcgaagtcgtagggtgtacgttccgtggacgggtctatcaccactctcaganacaactcgaagaacanagtcgtcttactacaaatacgaacacgactagacgtacctacgacgacgacggtccgttagttacgttttgcgacgtacgtactacttcgttacgttaaccgtaaagttcgttactacgtaccgacggtccgtaccgggg

SEQ ID NO: 425033 - DNA, 536 bp, Homo sapiens
  misc_feature: GZ8MTXP02FGP2D.44.27.C05.1.454.CMB.2.raw
  modified_base (269)..(269): a, c, t, g, unknown or other
  modified_base (300)..(300): a, c, t, g, unknown or other
  modified_base (418)..(418): a, c, t, g, unknown or other
  modified_base (423)..(423): a, c, t, g, unknown or other
  modified_base (427)..(427): a, c, t, g, unknown or other
  modified_base (440)..(440): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattnaccttcgataattggaatatgcagtggtccnccaggctccaggcgaggggctgggagtgggtgcgaggtgtgtacatttccatggagaaatcaaagtctacggtgaattccgttgagggccattcaccatctcagagacaatccgaaanaacanagtntctctacaaatanaacacgacagacgactacacgacgacgcgtagttagtttagtgcgagactactactacgttacgtaaacgtacgtactactacgtacgccgcggcg

SEQ ID NO: 425034 - DNA, 525 bp, Homo sapiens
  misc_feature: GZ8MTXP02GCHJP.44.27.C05.1.454.CMB.2.raw
  modified_base (341)..(341): a, c, t, g, unknown or other
  modified_base (375)..(375): a, c, t, g, unknown or other
  modified_base (396)..(396): a, c, t, g, unknown or other
  modified_base (401)..(401): a, c, t, g, unknown or other
  modified_base (403)..(403): a, c, t, g, unknown or other
  modified_base (410)..(410): a, c, t, g, unknown or other
  modified_base (413)..(413): a, c, t, g, unknown or other
  modified_base (415)..(415): a, c, t, g, unknown or other
  modified_base (418)..(418): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
  modified_base (437)..(437): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataaattggaatatgcagtggtccgcaggctccaggcgaggggctgggagtgggtggcagggtntgtcatttccatggaggaaatcaaagtcacggtnattcgtgagggcatcacatcncagananaatacanaananagntctctacaananananacngagacacagacgacgcgtgttatttgttgacgacgactactacttacgttactaaaacgtacgttacgtactacgtacgtcgtcggcg

SEQ ID NO: 425035 - DNA, 548 bp, Homo sapiens
  misc_feature: GZ8MTXP02F89KU.44.27.C05.1.454.CMB.2.raw
  modified_base (223)..(223): a, c, t, g, unknown or other
  modified_base (317)..(317): a, c, t, g, unknown or other
  modified_base (366)..(366): a, c, t, g, unknown or other
  modified_base (529)..(529): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatattcttagtcttaactttgtctcctggtatcaacatcatccaggtaaacgcccccaaaactcatcatctatgagcctataagnggccctgagggtttctaatcgcttcacctgcctccaagtccggacaacnccggcctcctgacaatctcgtcgggctccgaggctagaggacgagctgtattattattgttgctcagtatgttcgtcgctatctactttatgttacgtcggaagttcgggacctaaaggtccaaccgtccgtacgtccacgacccaaacggtccccaaacccnctcgtaccacgtcttcccg

SEQ ID NO: 425036 - DNA, 756 bp, Homo sapiens
  misc_feature: GZ8MTXP02HABUR.44.27.C05.1.454.CMB.2.raw
  modified_base (301)..(301): a, c, t, g, unknown or other
tcagacagtatatacacgaccggtgctcgatttagacgcgatcgaagggtttggggcatgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccaggtagggggtccctgagactctcctgtgcagcctctggattcaccttcgataattggaatatgcagtgggtccncaggctccgaggcgaggggctgggaggtggggtggcgaggtgtgtctatttcagtggaagaatcaagtctacgggtgtacgtttcccgttagggacggggtacctacgttaccgaacccgtaacgttccctacccgaacggtaaacgtaaaccgtaaaccgtttaacccggaaacggaaaacccgtaaccgtaaagggtttaccggtttaccctttaacgtttaaacctaaaaacgtttacggaaaaccgtaaccggtaccccgttacggaaccggtaaccccgttaccggaaacgggaacccggtaaaccggggtcccggtttaggtttaaacgttttttgggtacggtacggtaacggttaaccttaacgttccgtttacgttttaaacccgtaaaaacgtttccgggtttaactaacgtttaccggtaaccggttcccggttaacccggggg

SEQ ID NO: 425037 - DNA, 837 bp, Homo sapiens
  misc_feature: GZ8MTXP02FTRWV.44.27.C05.1.454.CMB.2.raw
  modified_base (189)..(189): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggttaatattcttagtcttaactttgtctcctggtatcaacatcatccaaggtaaacgcccccaaatcatcatctatgaggacctagtaagacgccctcgtaggggtttactaagtcgtcttacaccttcgccctaccgaaacggttcccggaccaaacccgtaccgggcccctacccccgttaggaaccctaaacgttcccgttccggttacgggggtacccttacccggaaacggggtccgttaacggggtaaacggggaacccggtaaacggggtcccgttaaagggttaactttttaaacgttttaaacgttttggttttaacgggtcctttaaccggtaagggttaacttttacgggtttcccgggttaccggtacccttaacggttaacccgttaaactttttaaacgttcgggtttacccgtttaaccgggggtaaaaggttaccgggggtaaacccgttaaaacgggggttcccctaaacccgggtttaccccgtttaacggggtacccgtaaaccgggaacccccgaaaacggggtaccccccaaaaacccccggtaaccttccggttaacccgtaaccctttccggttttaaccccccg

SEQ ID NO: 425038 - DNA, 767 bp, Homo sapiens
  misc_feature: GZ8MTXP02JY0P9.44.27.C05.1.454.CMB.2.raw
  modified_base (307)..(307): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctggagactctcctgtgcagcctctggattcaccttcgataattggaatatgcaggtgggtccnccgaggcctccgaggcggaggggctgggaggtggggtggcgagggtgtgtctatttccagtgggaaggtaaatcgaaagttcgtacgggtgtaacgtttccggttaggaccggggtcccgtatttcccaacccgtaactaccgttaccccgaaggtaacggtaaaccctaaacgtttaccccggaaacggtaaaacccaaccgtaggttaccgttacctttacctttaacaaaacgttacgtaaaaccgacggtacccgttaggaaccgtaaccccgttaccgaacgggtaacccgaccggggtacccgtttaggtttacgttttttacgggtacgtaccgtaaaaggttaaccttaacgttacccgtttaacggtttttaaaccccctaaaagtttacccggtttaaccgtaacgtttacccggtaacccggttccccggtaccgggggtaaccccggg

SEQ ID NO: 425039 - DNA, 687 bp, Homo sapiens
  misc_feature: GZ8MTXP02HAN73.44.27.C05.1.454.CMB.2.raw
  modified_base (355)..(355): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggaggcggtcggccccgaggtacggggggtccctgacgactctccgtgtgcagcctcgtggattcaccttcgataagttggaatatgcaggtcggtccgccaggctccgaggcggaggggctgggaggtggggtggacgngggtcgtgtcgtatttcccgaagtgggaaggaaaattcgaaaggttcgtacgggtgtacgtttcccggtaggtacggggaccgtacttccaacccgtattcctacccgaagacgaaacgtaacttacccggaaagtaaaccgaacgtaacgttcgttaccttacgttaaaccaaaagtacgaaacacggtaccgtacgaccgaccgtacgaacggaccgtacggtcgttagtttacgttttgtcgtacgtaacgtacgttacgttacctttacgtttaacctaaacgttcgttacgtacgttaccggaccggtcccggtacggggtacccgg

SEQ ID NO: 425040 - DNA, 589 bp, Homo sapiens
  misc_feature: GZ8MTXP02F3NHK.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtaggggggtccctgagactctcctgtgcagcctctggattcaccttcgataattggaatatgcagtggtccgccaggctccaggcgaggggctgggagtggggtggcgagggtgtgtctatttccagtggaggaaatcaagttctacgggtgatttccggttgagggtccgattccaccagtctccagagacaacttaccgaagaacacagtgttctcttacaactagaacacgacctagacgacctcgaacggaccgacggtccgttgttaacgtttttggtagtacgtagtacttacgttacttacgtttaccaaaacgttcggttactacgttcgtaccggccggtcgggtaacccgg

SEQ ID NO: 425041 - DNA, 539 bp, Homo sapiens
  misc_feature: GZ8MTXP02G5YD2.44.27.C05.1.454.CMB.2.raw
  modified_base (489)..(489): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcagcctctggattcaccttcgataattggaatatgcagtggtccgcaggctccaggcgaggggctgggagtgggtgcaggtgtgtcatttccagtggagaaatcaagtctacgggtgattccgtgacggggcctattccacatctcagagacaattccgagaacacagtgtactcttacaaatgaaacagacctagagacctcgacgaccaacggccgtgttactttgngtcgagtactatctcgttaccaaatcgtactactcgacgcgtacggaccg

SEQ ID NO: 425042 - DNA, 520 bp, Homo sapiens
  misc_feature: GZ8MTXP02I9R8U.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (261)..(261): a, c, t, g, unknown or other
  modified_base (276)..(276): a, c, t, g, unknown or other
  modified_base (336)..(336): a, c, t, g, unknown or other
  modified_base (354)..(354): a, c, t, g, unknown or other
  modified_base (433)..(433): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttctagtcttaacttgctctgtatcantcatccaggtaaacncccccaaatcatcatctatgagctataagaggccctgagggtttctaatcgcttcactcncctcacgtccggacaacnccggcctccctgacatctctgggcctccaggctggaggtacgagctagtattattattgttgctcagtatcgttcgtcncatcattatgttactggaagtcgggacctaaggtcctaccgtcgtacgtcacgacccaaggcccaacccactcgtcacgtcttcccg

SEQ ID NO: 425043 - DNA, 563 bp, Homo sapiens
  misc_feature: GZ8MTXP02FR8S2.44.27.C05.1.454.CMB.2.raw
  modified_base (302)..(302): a, c, t, g, unknown or other
  modified_base (374)..(374): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccnccaggctccaggcgaggggctgggagtgggtggcagggtgtgtcatttcatggagaaatcaagtctacggtnattccgtgagggccattcaccatctcagagacatccgagaacacagtgtctcttacaaatgaacagacctgacgacctcgacggacacggtccgttgttaactttttggcgacgaggtacttacttcttacgtttaaccaaaagttccggttactacgtttaccgaccgtccggtacggggaaccccgg

SEQ ID NO: 425044 - DNA, 569 bp, Homo sapiens
  misc_feature: GZ8MTXP02HH8FP.44.27.C05.1.454.CMB.2.raw
  modified_base (265)..(265): a, c, t, g, unknown or other
  modified_base (506)..(506): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctntggattcaccttcgataattggaatatgcagtggtccgcaggctccgaggcgaggggctgggagtgggtggcgaggtgtgtctatttccgagtggaggaaatcaaagtctacggtgtattccgttgaggggccagttcaccatcctaccagagactaacttccgaagaacacagtgtactcttacaaatgaaacagacctgacgacctacgacggaccgacggtccgttgttacttttggngtacgagtactatctgtttaccaaaagttcggttactacgttcgacgtccgtacggggacccg

SEQ ID NO: 425045 - DNA, 720 bp, Homo sapiens
  misc_feature: GZ8MTXP02HCXL4.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgagggtacgggggtccctgagactctcctgtgcagcctctggacttccaccttgattaagttggaatagtgcgaggtcggtcccgcgaggcctccgaggcggaggggctgggaggtgggtggcgtaggtgtgtactagtttccgagtaggaaagtaatcgtaagttcgtacgggtgtacgtttccggttaggacggggtacctactttacccgaccgtactcccgtacccgaagaacgtaacccgtaaacgttacccggaaacgtaaacctaacgtacgttacgttaccctttaccgttaaacctaaagttacgaaaccgtacggacccgttacggaaccgtacccgtacggaacgggtaacccgtaacgggttccgttacggttttagttttcggacgtacggtaaacgtactttacgtccgtttaacgtttaaaccgaaacgtttccgtactaccggtaccggtacggtcccgggtacggggaccccgg

SEQ ID NO: 425046 - DNA, 685 bp, Homo sapiens
  misc_feature: GZ8MTXP02FYZWC.44.27.C05.1.454.CMB.2.raw
  modified_base (263)..(263): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctntggattcaccttcgataattggaatatgcagtgggtccgccaggctccgaggcgaggggctggaggtgggtggcaggtgtgtcatttccgagtggaacggtaaatcgaaagttcgtacgggtgtaactttccggttaggacggggtccgtaaatttccaacccatacctcccgaagacgtaactaaacgttcccgaagaaaccaacgacgtagttaccttaccttaacaaaacttagaaacgaacgacccgttagacggaacctacgaacggaccgaacggtcccgggttagttaacggtttttcggtagtaccggtaaaggtaaccgttaatttaccgttacggttttaaaccctaaaaagtttccggggtttaactaaacgtttccggtaaccggtcccggttacgggggtaaccccggg

SEQ ID NO: 425047 - DNA, 740 bp, Homo sapiens
  misc_feature: GZ8MTXP02FQ9F6.44.27.C05.1.454.CMB.2.raw
  modified_base (315)..(315): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacggggggtccctggagactctcctgtgcagcctcgtggattccaccttgaattaagtggaatatgcaggtcggtccnccaggctccgagggcggaggggctgggaggtggggtggcgagggtgtgtctagtttcagtgggaagtaaatcgaaaggttccgtaacgggtgtacgtttccggttaggacggggtacccgtattacccgaccgtactcccgtacccgtaagaacgtaaccgtaaacgttacccggaaagaaacccgtaccgtagttaccgttaccttacctttaacgaaaagttacgaaaccacggtacccgttaggaaccggtacccctacggaaccggtaaccgaccggggttacccggtttacggtttagtttttacggtacggtaccggttaaacggtacctttaacgttcccgttttaacgttaacccgtaaaaacgtttccgggtttacttaaccgtttccggtaacccggtcccggttaacccggggg

SEQ ID NO: 425048 - DNA, 566 bp, Homo sapiens
  misc_feature: GZ8MTXP02FV3BA.44.27.C05.1.454.CMB.2.raw
  modified_base (315)..(315): a, c, t, g, unknown or other
  modified_base (339)..(339): a, c, t, g, unknown or other
  modified_base (352)..(352): a, c, t, g, unknown or other
  modified_base (383)..(383): a, c, t, g, unknown or other
  modified_base (533)..(533): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgcaggctccaggcgaggggctgggagtgggtggcaggtgtgtcatttcatggaggaaatcaagtctacggtgattccgtgaggccgattcaccatctccaganacaattccgagaacacagtgtctnttcaaatgaacancctgagacctcaggcacggctgtatttttgngcgagtactattctgtttaccaaaattcggttactattcgacgtccgtggggaccgtagggaaccctggtcaccgtctccgtccggcctccgaccgaacgggccccagtccggtccttcccccgtcggccgccctcgcctccgacggacnccaaccgtccgacgacgccacgacgccggcccg

SEQ ID NO: 425049 - DNA, 616 bp, Homo sapiens
  misc_feature: GZ8MTXP02FVFUZ.44.27.C05.1.454.CMB.2.raw
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtgggtccnccaggctccgaggcggaggggctgggaggtggggtggcgagggtgtgtctatttccgagtggaagaaatcgaagttcgtacgggtgtagtttccggtagacggggtccgtattccaccattcctccagagactaactccgaagaacactagtgtactacttacaaatagaacacgactagacgacctacgaacggacgaccggtccgttagtttacgttttggtcgtacggtaacgtacttacgttacttacgtttaaccgtaaaacgttcggttactacgttccgaccggtaccggtacggggtaacccgg

SEQ ID NO: 425050 - DNA, 682 bp, Homo sapiens
  misc_feature: GZ8MTXP02H94SK.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctctggattcacttcgataattggaatatgcagtcggtccgcaggctccgaggcggaggggctgggagtggggtggcgaggtgtgtctatttcagtgggaaggtaaatcgaaagttcgtacgggtgtacgtttccggttgaacggggtcccgtattacccaccctactaccgtacccgaggtacgaacgtaaacgttaccgaacgaaacaactacgtcgttaccttactttacctaaaagttacgaaacacgtaccgtacggaacgacctacgaacggacgtaccgggtacgttacggtttaacgtttttggttaggtacggtaaacggtacgttacttacgtttaccgtttaaacctaaaaacgtttccggttaccttacgtttaccggtacccggtaccggttacgggggaaccccggg

SEQ ID NO: 425051 - DNA, 757 bp, Homo sapiens
  misc_feature: GZ8MTXP02GE6RL.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggacttcaccttcgataaattggaatatgcaggtgggtccgccgaggctccgaggcggaggggctgggagtggggtggcgagggtgtgtcattttccgagttgggaagtaaatcgaaagttcgtacggggtagacgtttccgggttaggacggggtcccgaatttccgaaccctagttaccctaccgaacggaacggaaacctaaaacgtttacccggaaaggtaaaccctaacgaacgttacgttacctttaccgttaaacctaaaacgttaacggaaaacctaacggtacccgttaacggaacgaaccctacgaaacggaccgtaaaccggggtccgttacggtttaagtttttcggtacggtacgtaaacggtaaccttaacgtttaccgttaacgttttaaacccgtaaaaagtttcccgggtttaaccgttaacggtttacccggtaaacccggttacccgggttaccgggggttaaaccccggggg

SEQ ID NO: 425052 - DNA, 662 bp, Homo sapiens
  misc_feature: GZ8MTXP02FWEN7.44.27.C05.1.454.CMB.2.raw
  modified_base (339)..(339): a, c, t, g, unknown or other
  modified_base (365)..(365): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgccaggctccaggcgaggggctggaggtgggtgcaggtgtgtcatttcagtggaaggaaatcaaagtctacggtgtattccggtgacgggcctattcaccatcaccagaagacaattccgaagaacanagttgtcctacttaacaaatgaaacncgcctagaacgaccctcgagggaccacggggtacctttgtttaattttttcggacgtaccggtaaagtaacttaaacttcgttacgtttaaccctaaaagttccggttactagttccgacgtaccgtcggggacccgaacgggtaaccctcggttccacccggttctcccgtcccggcctacccgaccgaacggccctacgtccggtcccttcccccgtcggcccgtcccgtcgcccttaccgacggaccgcccgaaccgtcccggaagacccgacgaaccgacggcccggtcccgg

SEQ ID NO: 425053 - DNA, 637 bp, Homo sapiens
  misc_feature: GZ8MTXP02H7WJ7.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgagggtacggggggtccctggagactctcctgtgcagcctctggattcaccttcgataattggaatatgcagtggtccgcaggcctccgaggcggaggggcgtgggaggtggggtggcgagggtgtgtctattccagtgggaagaatcgaagttcgtacggtgtattccggttggacgggccgtattccacccgatcctaccagagaactaacttaccgaagaaaccactagtctcttacttacaaatagaacacgacctagaacgtacctacgacggaaccgacggtccgttaggtttacgttttaggtggtaccgtaagtacgttacgtacctttacggtttaaccctaaaacggttccggttactacgttaccggtacccggtacccggttacgggggaaccccgg

SEQ ID NO: 425054 - DNA, 587 bp, Homo sapiens
  misc_feature: GZ8MTXP02HYY01.44.27.C05.1.454.CMB.2.raw
  modified_base (284)..(284): a, c, t, g, unknown or other
  modified_base (331)..(331): a, c, t, g, unknown or other
  modified_base (336)..(336): a, c, t, g, unknown or other
  modified_base (343)..(343): a, c, t, g, unknown or other
  modified_base (352)..(352): a, c, t, g, unknown or other
  modified_base (365)..(365): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcagggtgtgtcatttcatggaggaaatcaagtctaggtnattccgtgagggccgattcaccatctccagagacaattccgagaacncagtntctctanaaatgaacngcctagagacctnaggacacgggccgttgttatttttgagcgtagtactatcttcgtttaccctaaaattcggttactattcgacgtccgtggggaccacggggaaccctggtaccaccgttccgtcccgtccgcctaccgaccgaacgggcccacgtccgtccttcccccgtggcctccctcgcctccgacggcgaccgaaccgtccgacgacgaccaccgacggccggcccgg

SEQ ID NO: 425055 - DNA, 535 bp, Homo sapiens
  misc_feature: GZ8MTXP02FVZCY.44.27.C05.1.454.CMB.2.raw
  modified_base (189)..(189): a, c, t, g, unknown or other
  modified_base (223)..(223): a, c, t, g, unknown or other
  modified_base (363)..(363): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccaggtaaagcccccaaactcatcatctatgagcctataagaggccctcaggggtttctaatcgcttcactcgcctcaagtccgacaacncggcctccctgacaatctctgggctccaggctgaggacgaggctgattattatgttgctcagattgttcgtgcatctacttatgttcttacgggaagtcgggacctaaggtccaaccgtcctacgggtacacggacccaacggacccaaacccactcgtcacctcttacccg

SEQ ID NO: 425056 - DNA, 606 bp, Homo sapiens
  misc_feature: GZ8MTXP02HFDAO.44.27.C05.1.454.CMB.2.raw
  modified_base (350)..(350): a, c, t, g, unknown or other
  modified_base (386)..(386): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattccaccttcgataattggaatatgcaggtcgggtccgccaggcctccgaggccgaggggctgggagtggggtggcgagggtntgtctatttccagtggaggaaatcaagtctacggtntagttccgtgagggtccgattcacatctaccagagacaacttccgaacgaacacacgtgtactcttacgaaattcgaacacgtaccgtagaacgtacctacgacggacgtaccggtcgttacgtttacgtttttggacgtacggtaacggtacttacgttcttacgtttaacctaaaacgttcggttactacgttaccgacggtccgtacgggaacccgg

SEQ ID NO: 425057 - DNA, 551 bp, Homo sapiens
  misc_feature: GZ8MTXP02FVD7I.44.27.C05.1.454.CMB.2.raw
  modified_base (189)..(189): a, c, t, g, unknown or other
  modified_base (223)..(223): a, c, t, g, unknown or other
tcagacagtatatacacgaccggtgctcgatttagacgcgatcgaaggatttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctcctggtatcaacatcatccaggtaaacgcccccaaactcatcatctatgagacctataagagccctcgtagggtttcaatcgcttccactgcctcaagtccggcacacgcctcctgacaatctctggctccgagctggagacgagctagtattattattgtgctacagtattcgttcgtccgatattctaacttgtcgttcgttacgggtaagtcggggaactaaacgggtccaccggttacctacgggtccacggaacccgaacggacccaaccccactacgtaccactttcccg

SEQ ID NO: 425058 - DNA, 724 bp, Homo sapiens
  misc_feature: GZ8MTXP02HYVIT.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcaggtcggtccgccaggctccgaggcggaggggctgggaggtggggtggcgagggtgtgtctatttccgagtggaagaaatcgaaagttcgtacgggtgtaactttcccgggttagacggggtcccgtatttacccaacctactcctacccgagaacggtaaaccctaaacgttacccgaacgtaaaccaacgtacgttacgttacctttaccttaaactaaaacgttacgaaaaccgtacgtaccccgtaaggaaccgtaacccgttaccggaaacgggtaacccgtaaaccgggtcccggtttagtttacggtttttacggttacggtaccgtaaacggttaaaccctttagttaccgtttacgtttaaaccgtaaaacgtttccggttaactacgttaccggtaccggtccggttaccgggggaaccccgg

SEQ ID NO: 425059 - DNA, 675 bp, Homo sapiens
  misc_feature: GZ8MTXP02HFBNH.44.27.C05.1.454.CMB.2.raw
  modified_base (356)..(356): a, c, t, g, unknown or other
  modified_base (369)..(369): a, c, t, g, unknown or other
  modified_base (422)..(422): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcagcctctggattcaccttcgataattggaatatgcagtcgggtccgccaggcctccgaggcggaggggctgggagtggggtgcgaggtgtgtcatttcagtggagtaaatnaaggtctacggtnattccggtgacggccgattccacctatcctaccagacgactaacttacccganaaaccactagtcgtacctacttaccaaaagtacgaaccacgtccctaggaccgtaaccctacgaacggtaaccgaccgggtacccgttgtttaacgtttttggacggtacggacgttaaccttacttaccgtttacgtttaaaccctaaaagtttccggttaacctacgtttaccggaaccgtcccgtacgggggtaacccgaacggggtaccccgttacgggtacccctacccggtccttccccgtacccgg

SEQ ID NO: 425060 - DNA, 519 bp, Homo sapiens
  misc_feature: GZ8MTXP02ILECZ.44.27.C05.1.454.CMB.2.raw
  modified_base (187)..(187): a, c, t, g, unknown or other
  modified_base (221)..(221): a, c, t, g, unknown or other
  modified_base (312)..(312): a, c, t, g, unknown or other
  modified_base (359)..(359): a, c, t, g, unknown or other
  modified_base (414)..(414): a, c, t, g, unknown or other
  modified_base (427)..(427): a, c, t, g, unknown or other
  modified_base (503)..(503): a, c, t, g, unknown or other
tcagacagtatatacacgaccggtgctcgatttagacgcgatcgaagggtttgggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcatccagtaaacgccccaaactcatcatctatgagcctataagnggccctcagggtttctaatcgacttcacctgcctcaagtccgcaacncggcctcctgacaatctctggctccagctgagcgagctagatattatgttgcttnagtatgttcgtcnctatctacttgtgttacgttacggaagtcggactaggtccaccgttcgtacgccacgacccgaacgcccaaacccnctcgtacctactctcg

SEQ ID NO: 425061 - DNA, 518 bp, Homo sapiens
  misc_feature: GZ8MTXP02HW6QB.44.27.C05.1.454.CMB.2.raw
  modified_base (188)..(188): a, c, t, g, unknown or other
  modified_base (222)..(222): a, c, t, g, unknown or other
  modified_base (267)..(267): a, c, t, g, unknown or other
  modified_base (279)..(279): a, c, t, g, unknown or other
  modified_base (283)..(283): a, c, t, g, unknown or other
  modified_base (289)..(289): a, c, t, g, unknown or other
  modified_base (309)..(309): a, c, t, g, unknown or other
  modified_base (351)..(351): a, c, t, g, unknown or other
  modified_base (439)..(439): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctcctggtatcaacntcatcaagtaanccanaaactnatcatcatgagcctataagngcctgagggtttctaatcgcttccactgcctcaagtcccganaccgcgcctcctagacatctctggcctcagctgaggacgagctagtattattattgttgctcgagtattgttcgtcgcatcactttangttcttacggagtcggaccaagtcaccgtcgtacgtcacgaacccgaaaggacccctaacccacgtcgtacctactccg

SEQ ID NO: 425062 - DNA, 530 bp, Homo sapiens
  misc_feature: GZ8MTXP02IR4P0.44.27.C05.1.454.CMB.2.raw
  modified_base (265)..(265): a, c, t, g, unknown or other
  modified_base (299)..(299): a, c, t, g, unknown or other
  modified_base (331)..(331): a, c, t, g, unknown or other
  modified_base (366)..(366): a, c, t, g, unknown or other
  modified_base (390)..(390): a, c, t, g, unknown or other
  modified_base (408)..(408): a, c, t, g, unknown or other
  modified_base (429)..(429): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctcctgtgcagcctntggattcacttcgatatgaatatgcagtggtccncaggctccgaggcgagggctggagtgggtgcnggtgtgtcatttcatggagaaatcaagtctaggtnagttccgtgagggccatcacatcncagagacatcgagaacanatgtctctactaatagaacanctagacgactacgagacacgccgttagttattttgtcgtcgacgtactacttcttacgttaactaaaacgttcggttactagtacgtacgtccgtacgggg

SEQ ID NO: 425063 - DNA, 577 bp, Homo sapiens
  misc_feature: GZ8MTXP02F0TII.44.27.C05.1.454.CMB.2.raw
  modified_base (188)..(188): a, c, t, g, unknown or other
  modified_base (222)..(222): a, c, t, g, unknown or other
  modified_base (233)..(233): a, c, t, g, unknown or other
  modified_base (355)..(355): a, c, t, g, unknown or other
  modified_base (445)..(445): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaacttgctctggtatcaacatcatccaggtaaacgccccaaacacatcatctatgagcctataagagccctcgagggtttctaatcgcttcacctgcctcaagtcgcaacncgcctcctgacaatctctgggcctccaggctagaggtacgaggctgattattatgttgctgacgattgttcgtcgactagtcactttagngtttacgtacgggtaaagttcgggaccctaaaagggtcctaaacccggttcccgtaacgggttaccacggaacccctaaagggaccccctaaccccaaaccgtcggttacccaaccggtttcctttccccgg

SEQ ID NO: 425064 - DNA, 730 bp, Homo sapiens
  misc_feature: GZ8MTXP02HJGHK.44.27.C05.1.454.CMB.2.raw
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccncaggctccgaggcgaggggctgggagtggggtggcagggtgtgtctatttccagtggagaaatcgaaagtctacgggtgtactttccggttgacggggtcccgtaatttcccgaaccctacttaccttacccgaggaacggtaacctaaacgtttacccggaaaggtaaaccctaaccgtaagttcggttaccttaccgtttaaactaaaacgttacgtaaaacgacggtaccccgttaggaaccggtaaccccgttacgaacggggaacccgtaacccggggtacccggtttaggtttaacgttttttcggtacggtaccggtaaacgtaccgttaacttaccgtttacgttttaaacccgtaaaaacgtttccgggtttactaacgtttaccggtacccggtacccggttacgggggaacccccgg

SEQ ID NO: 425065 - DNA, 699 bp, Homo sapiens
  misc_feature: GZ8MTXP02HVLGQ.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctcgtggacttccaccttcgattaagttggaatatgcgaggtcggtcccgcaggcctccgaggcggaggggctgggaggtgggtggcaggtgtgtctatttccagttggaagtaatcgaagttcgtacggtgtattccggttggacgggtcctaattcccgaccctatcctacccgaagacgaactaacgttaccggaaacgtaaaccgaacgtacgttacgttaccttaccttaacgtaaaacgtttacgaaaaccgacgtaccccgttaaggaaccgtaacccgtaccggaacggaacccgtaccgggtaccgttaggttttaaccgttttggttacggtacgtaacggtaccttacgttaccgtttacggtttaaaccctaaaacgtttccgttacgtacgttaccggtacccgtccggttaccggggtacccgg

SEQ ID NO: 425066 - DNA, 697 bp, Homo sapiens
  misc_feature: GZ8MTXP02H7V0L.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtgagtcgtgggggaggcgtggccccaggtacggggggtccctggagactctcctgtgcagcctctggattcacttcgataatggaatatgcagtgggtcccgcaggcctccgaggcgaggggctgggaggtggggtggcgagggtgtgtctatttccagtagggagaaatcgaaagtcgtaggtgtattccggttgacggggcccgtatttacccaccctactcctacccgaaggaacgaacctaaacgtttaccccggaaaggaaaaccaaccgtagttacgtaaccgtttcctttaaacaaaagtttacggaaactacggtacccgttaggaaaccgacccgtacgaacggaaccgtacccgggtaccggttagtttaacgtttttggtcggtacgtacggtaacttacgttacgtttacggtttaaccctaaaacgttccggtttacctacgtttacccggaaccggtccccggttacgggggaacccccgg

SEQ ID NO: 425067 - DNA, 705 bp, Homo sapiens
  misc_feature: GZ8MTXP02FJ7XI.44.27.C05.1.454.CMB.2.raw
  modified_base (304)..(304): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgccatgtgtcaggtgcaattcgtggagtctgggggaggcgtggccccagtaggggggtccctgagactctcctgtgcagcctctggattcaccttcgataattggaatatgcagtggtccncaggctcgaggcgaggggctggagtgggtggcaggtgtgtcatttcagtggaggaaatcaaggtctacggggtgtaacgtttccgttaggacggggccgtactttccgacctaacgttcctaccgaggtaagaacaacgttaccggaaacgaaaccaacgtacgttacggttacctacctttaaccgaaaattacgaaaaccgacgtaccccgttagaaccggtaacccgttaccgaacgggaacccgtaaaccggggtccccggtttaggtttacgttttttaggtacggttaccggtaacggtaacctttacgttaccgtttacggttttaacccctaaaaacgtttccgggtttaacctaccgtttacccgggaaccgttcccggttaacccgggggg

SEQ ID NO: 425068 - DNA, 601 bp, Homo sapiens
  misc_feature: GZ8MTXP02IERXQ.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtcgggtccgccaggctccgaggccggaggggctgggagtggggtggcagggtgtgtctagtttccagtgggaggaaatcgaaagttcgtacgggtgtattcccgggttagacgggggcccgtattccaccctactcctaccgagaacgaacaacgttccgaacgaacacgagtcgtcttacttacaaatgaactagcctagacgacctcgacggacgacggtccgttgttacgttttgtgtcgagtacttactcttgttacctaaaacgttcggttactacgttacgaccgtccgtacgggacccg

SEQ ID NO: 425069 - DNA, 608 bp, Homo sapiens
  misc_feature: GZ8MTXP02F7ULM.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtaggggggtccctgagactctcctgtgcagcctctggattcaccttcgataattggaatatgcagtggccgcaggctcaggcgaggggctgggaggtggggtggcgaggtcgtgtcatttccagtggaaggaaatcgaaagttcgtacgggtgagtttccgttggacggggtccgtaattcccaccctatcctacccagaacgaactaacttcccgaagaaaccacgagtcgttacctacgttaccaaaattcgaaacacgcctagacgacctcgacgggccacggccgttgttagttttgtgtcgtagtacttacgtcttacgtttaaccaaaagtttccggttactacgttaccgaccgtccggtacgggtacccgg

SEQ ID NO: 425070 - DNA, 633 bp, Homo sapiens
  misc_feature: GZ8MTXP02G9G7Y.44.27.C05.1.454.CMB.2.raw
  modified_base (251)..(251): a, c, t, g, unknown or other
  modified_base (270)..(270): a, c, t, g, unknown or other
  modified_base (272)..(273): a, c, t, g, unknown or other
  modified_base (275)..(275): a, c, t, g, unknown or other
  modified_base (279)..(279): a, c, t, g, unknown or other
  modified_base (284)..(284): a, c, t, g, unknown or other
  modified_base (300)..(300): a, c, t, g, unknown or other
  modified_base (362)..(362): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtcggccccgaggtacgggggtccctgagactctcctgtgcagcctntgattcacttgatatgatngnngnggcncagcncgaggcgaggctgggngtggggtggcgaggtgtgtctatttcgagtagggaagaaactcgtaaaggtctaacgggttnacgtttccggttaggacggggtccctattcccgaacctattccaccgagtaacgaactaacttaccgaagaaaccacgagttcgtacttacttacaaatagaacagtccagacacctacgagacgacggtcgttagtttagtttgtacgtacgtagtacgttatacttacgtttaacctaaagtttccggttactacgttaccgtaccgtccggttacggggccggaaccgggtacccgtacggtccgtacccggtcctacccgtccccgg

SEQ ID NO: 425071 - DNA, 677 bp, Homo sapiens
  misc_feature: GZ8MTXP02G4XBU.44.27.C05.1.454.CMB.2.raw
  modified_base (189)..(189): a, c, t, g, unknown or other
  modified_base (224)..(224): a, c, t, g, unknown or other
  modified_base (300)..(300): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcactgganccagcgtaatattctagtcttaattgtctctgtatcaacatcataccaaggtaaacaccccaaactcatcatctangagcctaataagacgccctcgtagggtttctaatcgtcttcacctcgcctaccaacgtccgacaacgacccggtcctccctagaacctaactcctacgtcgggccctaccgaaggtcccgtagggaaccgggacggagggtctaggtaatttaatttagttgtttacgacttacgaagtacgttcggtttccgtacgacctaagttctaacgtttacgtcgtttaccgttacgggaaaacggggttaccgggtaaacccgtaaacgggtacccgtacccggtaccgttaacgggttaccccgaaccggtaacccccgaaaaccggtcccccaaaacccccggtacttacggtacccctaacttcccgtttacccccg

SEQ ID NO: 425072 - DNA, 556 bp, Homo sapiens
  misc_feature: GZ8MTXP02F3T3N.44.27.C05.1.454.CMB.2.raw
  modified_base (346)..(346): a, c, t, g, unknown or other
  modified_base (379)..(379): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccgccaggctccgaggcgaggggctgggagtggggtggcagggtgnggtcatttccatggagaaatcaagtctacggtnagttccggttgacggggccctagttccaccgatcctcccgagagacaaacttccgaacgaaacacagtgtctactaccaaatgaacagacctgacgacctcgacggacgacgccgtgttactttgtgcgagactatctgtttaccaaagtcgtacacttacgacgccgtgggacccg

SEQ ID NO: 425073 - DNA, 571 bp, Homo sapiens
  misc_feature: GZ8MTXP02HPTQT.44.27.C05.1.454.CMB.2.raw
  modified_base (283)..(283): a, c, t, g, unknown or other
  modified_base (311)..(311): a, c, t, g, unknown or other
  modified_base (389)..(389): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggtccgccaggctccaggcgaggggctggagtgggtggcaggtgtgtcatttcatggaggaaatcaagtctacggtnattccgtgaggccatcacatctccaganacaattccgaagaacacagtgtctcttacaaaatgaaacagcctagagacctcagggacacggcgttgttatttttgngcgagactatcttgttacctaaaattacggttctattcgacgtccgtcggggccgacggggaaccctcggtacaccgtcctcccgtccgcctaccaccgaacgggcccacgtccgtccttcccccgtcggccgccctcgcctccgacggacgccaaccgtccgacgacgcacacggcgcccg

SEQ ID NO: 425074 - DNA, 591 bp, Homo sapiens
  misc_feature: GZ8MTXP02IRDIT.44.27.C05.1.454.CMB.2.raw
  modified_base (230)..(230): a, c, t, g, unknown or other
  modified_base (305)..(305): a, c, t, g, unknown or other
  modified_base (389)..(389): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccagggcacaggatcctgggctcagtctgccctggctcagccctccctccgtgtccgggtctcctggacagtcagtcaccatctcctgcactggaaccaacngtgacgtcggttcgtttgaccgtgtctctggtaccagcacgaccccagaaaccacgacccccaaatcattattancgcgtacaatcgttccgccccgttcggtcgtccctgacgcgtcttctcgtcggtaccccagtctggacaacgccggcctcccgngacctatcctacgtcgggacctccgagtctggacggacgaggctagtattattacgtgacagtctacataactaacgaaggtacggtaaactactttacgtacgttcggacgtacgaacggacaacgtcgtacgtaccgtacgtacgtcacgtacccaacggcctccgccccgtcggtaccacgtcctccgttaccctaccc

SEQ ID NO: 425075 - DNA, 582 bp, Homo sapiens
  misc_feature: GZ8MTXP02JEDF9.44.27.C05.1.454.CMB.2.raw
  modified_base (189)..(189): a, c, t, g, unknown or other
  modified_base (362)..(362): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctgtatcaacatcatccagtaaacgccccaaactcatcatctatgagcctataagacgccctgtagggtttctaaatcgcttcacctgcctaccaagtccgcaacnccggcctcctgacaatctctggctccgagctgaggacgagctgattattattgttgctacagtattgttcgtcgctactctaactttattcgttacgttacgggaaggttacgggaaccgtacgggtacccacccggttaccgtacggtaccgaaccggaaccccgaaacgggtacccccaaaccccgtacgtccgtaccctaccgtcccgtttccccgg

SEQ ID NO: 425076 - DNA, 695 bp, Homo sapiens
  misc_feature: GZ8MTXP02GQLGB.44.27.C05.1.454.CMB.2.raw
  modified_base (331)..(331): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggtttccgtcgttaggccctcttaagaggtgtcatgtgtcaggtgcaattcgtggagtctgggggagcgtggccccagtagggggtccctgagactctcctgtgcagcctctggatcacttcgataattggatatgcagtggtccgcaggctccaggcgagggctggagtgggtggcgnggtgtgtctattcgtagtgaggaaagtacgtaagtacgtacggtgtaagttcccggttggtacggggaccggtacgttactaccgtaacgtccttaccctaaccgtaaggaacgtaaactttaccgtaacggtaaaccgtaaccaaagtacggttcgttacctttaacctaaattaacggtaaactaacggtacctacgtaacggtaacctaccgaacggtaaccgaaaccggtacccggtcggttaacgttttacggtttacggttcggaacggtaacgttagttacccgttagtttaacccgttaaaattaacgggttaccgtacttaccggttaaccgaccggttcggggtaaccccgggg

SEQ ID NO: 425077 - DNA, 616 bp, Homo sapiens
  misc_feature: GZ8MTXP02G79AD.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctctggattccaccttcgataattggaatatgcagtgggtccgccagggcctccgaggcggaggggctgggaggtggggtggcgagggtgtggtcagtttcagttgggaaggaaatcaagtcgtacggtgacttccgtgacgggcctattcgacactctccagacgactaacttccgaagaacacaagtcgtacttcttactaaatacgaaacacgcccgtagacgtacctacgacggacgaaccgggtccgttagttacgtttttcggtcgtaccggtaacgacttacgttcttacggtttaacctaaaacgtttccggttactacgttccgaccggtccgtaccggggg

SEQ ID NO: 425078 - DNA, 724 bp, Homo sapiens
  misc_feature: GZ8MTXP02GYXMM.44.27.C05.1.454.CMB.2.raw
  modified_base (301)..(301): a, c, t, g, unknown or other
  modified_base (385)..(385): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtcggcccgaggtacgggggtccctgagactctctgtgcagcctctggattcaccttcgataattggaatatgcagtggtccncgaggctccaggcggaggggctgggagtgggtggcaggtgtgtctatttccagtggaaggaaaatcgaaagttcgtacggggtntaacgtttcccggttagggacggggtcccgtaatttcccaacccgacttacccttaccaacggaacgtaaactaaacgttacccgaaagaaaaccaacgtacgttacggttaccttactttaaacaaaacgtttagaaaaccgtaacggtaccctacggaaaccgtaaccccgtacgaaaccgggaaccgaaccgggtacccggttacgtttaagtttttcggtacggtacggtaaacgtaacgttacgttaccgtttacgtttaaacccgtaaaaacgttccggtttaacctaacgttaccgtaacccggttacccggtaccgggggtaacccccggg

SEQ ID NO: 425079 - DNA, 815 bp, Homo sapiens
  misc_feature: GZ8MTXP02JCVJU.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcgaggtgcaattcggtggagtcgtgggggaggcgtcggccccgagggtacggggggtccctggagactctcctgtgcagcctcgtggattcaccttgataattggaatatgcagtggtccgccaggcctccgaggcgaggggctgggagtggggtggcgtagggtgtgtactatttccgagtagggaagtaaatcgaaaggttctacggggttgtaacgtttcccgggttaggaacgggggtccctaaatttcccgaaaccctacttaccgtacccgaaggaaacgtaaaccgtaaaacgtttaccccggaaagtaaaacccgtaaccgtaaacggttcgtttaaacccttaccgtttaaacctaaaaaacgttaccgggaaaaccctaacgggtacccccgtttaaaggaaaccggttaaacccccgttacggaaaccggggtaacccgtaaccgggggttacccggtttaagttttaaacggttttttcggtaacggttaccggtaaaacgttaaccgtttaaacgtttacccgttttaacgtttaaaaccccgtaaaaaggtttcccggttaaacttacggttacccggtaccggtaccccggtacgggggtaaacccccggg

SEQ ID NO: 425080 - DNA, 511 bp, Homo sapiens
  misc_feature: GZ8MTXP02HHNHQ.44.27.C05.1.454.CMB.2.raw
  modified_base (422)..(422): a, c, t, g, unknown or other
  modified_base (432)..(432): a, c, t, g, unknown or other
  modified_base (441)..(441): a, c, t, g, unknown or other
  modified_base (456)..(456): a, c, t, g, unknown or other
  modified_base (511)..(511): a, c, t, g, unknown or other
tcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgaggggctgggagtgggtggcaggtgtgtcatttcatggaggaaatcaagtctacggtgattccgttgagggccgattcaccatctccagagacaattccgagaacacagtgtctcttcaaatgaacagcctgagacctcaggacacggccgtgtattttgtgcgagactatctgtttccaaaatcggtcattccgacgcctggggccagggaccctggtcaccgtctcctcgcctccacacgggcccatcgtctcccctggccncctgctcagncacctcgangcacagcgcctggcngcctgcaggctacgtctatactactgtctgacgcgggctcggcacggcacatagn

SEQ ID NO: 425081 - DNA, 648 bp, Homo sapiens
  misc_feature: GZ8MTXP02HYZTA.44.27.C05.1.454.CMB.2.raw
  modified_base (262)..(262): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcngcctctggattcaccttcgaataattggaatatgcgaggtcgggtcccgcaggtcctccgaggcggaggggtcgtggggaggtggggtggcgagggtgtgtctagtttcgagtggaaggaaacttcgaaaggttcgtacggggttgtacgtttcccggttagggacgggtccgtatttcccgacctactccgtacccgaagaacgaacctaaacgttaccgaacgaaacacgtagtcgtacttacttaacaaattacgaacagaccgtagacgacctcgaacgacgacggtccgttagtttattttggtgtacgtagtacttacttacttacgtttaaccgtaaagttcggttactacgttaccgaccgtaccggtcgggaacccg

SEQ ID NO: 425082 - DNA, 598 bp, Homo sapiens
  misc_feature: GZ8MTXP02IOOZM.44.27.C05.1.454.CMB.2.raw
  modified_base (285)..(285): a, c, t, g, unknown or other
  modified_base (384)..(384): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccncaggctcaggcgagggctggagtggggtgcaggtgtgtcatttcagtggaggaaatcaaagtctaacggtgacttccgttggaggtccgaattccaacntcctccagtacgactaattaccgagaacacagtcgtctacttacaaattagaaacagcctagaacgaccctacgaagggaccacgggacccgttgttaactttttggtgacgagtaacgtattacttcgtttacctaaaattccgggttacacgtttcgacgtccgtacggggccgtaacgggaccctcggtaccaccgtcgtacccgtcccgg

SEQ ID NO: 425083 - DNA, 593 bp, Homo sapiens
  misc_feature: GZ8MTXP02JJDDW.44.27.C05.1.454.CMB.2.raw
  modified_base (189)..(189): a, c, t, g, unknown or other
  modified_base (223)..(223): a, c, t, g, unknown or other
  modified_base (469)..(469): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctctggtatcaacatcatccaggtaaacgcccccaaatcatcatctatgagcctataagacgccctgagggtttctaatcgacttcacctcgcctaccgaacgtccggacaacgaccggtccctccctagaacctaactcctacgttcgggccttaccgaggcctaggacggacgagtctagtatttattatgttgactgaagtattgttcgtcnctattctaacgttatcggttacgttaggaaggttcgggaaccgtaaaggtcccgtaaccgtccgtaacggtccgaaccgacccgaaacggccccctaaacccgactcgtccctactccttcccg

SEQ ID NO: 425084 - DNA, 636 bp, Homo sapiens
  misc_feature: GZ8MTXP02IZY5B.44.27.C05.1.454.CMB.2.raw
  modified_base (300)..(300): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgcaggctcaggcgagggctggagtgggtgcgaggtgtgtcatttcagtggagaatcaagtctacggtgattcgtgaggccatcacatcncagagacatccgaagaacacagtgtctctacaaatcgaacagcctaggacaccctagacggacacgggtaccgttagttaacttttaggcgacgtagtacttattcgttacgtttaacctaaaagttccggttactacgtttccggacgtacccgtgggggacccgaacgggtaacccgttcgggtacctacccgttccgtcccgtcccggtccctaccgaaccgtaaccgggcccctacgtccggtcccttcccccgtggcccgtcccgtacgcccgtaccgacggaccgacctaacccgtccgaacgaccgaccgacgccggacccggtcccgg

SEQ ID NO: 425085 - DNA, 579 bp, Homo sapiens
  misc_feature: GZ8MTXP02JM9KR.44.27.C05.1.454.CMB.2.raw
  modified_base (189)..(189): a, c, t, g, unknown or other
  modified_base (223)..(223): a, c, t, g, unknown or other
  modified_base (482)..(482): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatattcttagtcttaacttgtctctgtatcaacatcatccaggtaacgccccaaactcatcatctatgagcctatagacgccctgtagggtttctaatcgcttcacctcgccctcaacgtccggacaacgccggtccctccgtacgaaccaattcctcgtagggccctaccgaggtccgtaggacggacgacggtctagtatttattagttgttagccttagacgttattcggttcgtcactatctaattntcgttagttacggaggttacgggaaccaggtcacccgttactagggtaccacggacccaaggtcccccaaaccctctcgtcctacctcgttaccccg

SEQ ID NO: 425086 - DNA, 610 bp, Homo sapiens
  misc_feature: GZ8MTXP02IBZ6W.44.27.C05.1.454.CMB.2.raw
  modified_base (333)..(333): a, c, t, g, unknown or other
  modified_base (380)..(380): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggcccgaggtagggggtccctgagactctcctgtgcagcctctggattcaccttcgataatggaatatgcagtggccgcaggctccgaggcgaggggctgggagtgggtgcgnggtgtgactatttccgagtggaaggaaatcgaaagttcgtacgggtntacgtttccggttaggaccgggtccgaatttccaaccctatcctacccaagacgaactaacttacccgaaagaaacaccgtagttcgtaccttacttacctaaaatacgaaacacgccctagaaccgtacacgacggacaccggtccgttagtttactttcggtgccgtagacttactcgttagttaaccaaaagttcgtactacgttccgaccgtcgtacggggacccg

SEQ ID NO: 425087 - DNA, 557 bp, Homo sapiens
  misc_feature: GZ8MTXP02FPKFP.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgatattggaatatgcagtggtccgcaggctcgaggcgaggggctggagtgggtggcaggtgtgtcatttcgatggaggtaaatcgaagtcgtacggtgtattccgtgaggccgtattcgacatctcagagacatcgagaacacagtagtctctacaaatgaacagcctagacgacctacgacggacgacggccgtcgttagttttgtcgtcgtaacgactactcttacgttaaccaaaacgttcggttactacgtttacgaccgtccgtaccggggg

SEQ ID NO: 425088 - DNA, 670 bp, Homo sapiens
  misc_feature: GZ8MTXP02GU2E1.44.27.C05.1.454.CMB.2.raw
  modified_base (300)..(300): a, c, t, g, unknown or other
  modified_base (387)..(387): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagctctcctgtgcagcctctggattcaccttcgataattggaatatgcagtggtccncaggctccgaggcggagggctgggaggtggggtggcgaggtgtgtctagtttccgagtgggaagaaatcgaaagttcgtacgggttntagtttcccggttaggacggggccctaatttcccgaacctacttaccctacccgaagacggaactaaacgttaccggaagaaaccgtaaccaaaggtcgttaccttactttaaccaaaaattacgaaacgacggtacctacgaacgaccctacgaacggaccgaccgggtaccgtgtttaactttttgtaggaccgtaagtacttacgttaccttacggtttaaaccctaaaagttccggttaactacgttaccggaaccggtcccggtacggggtaacccgg

SEQ ID NO: 425089 - DNA, 566 bp, Homo sapiens
  misc_feature: GZ8MTXP02JLD6Q.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtacgggggtccctgagactctcctgtgcagcctctggattcaccttcgatatggaatatgcagtggtccgcaggctacgaggcgaggggctggagtgggtgcgaggtgtcgtctatttcagtggaaggtaatcgaaagtcgtaacggtgtacttccgttgacggggcctattcacctatcaccagagacaacgttccgaagaacactagtgtctactacaaatgaacacgctacgacgtacacacggacgacggtaccgttcgttacgttttgcgtacggatactaactcttacgttaactaaacgtcggttacagttcacggtcgtaccgggg

SEQ ID NO: 425090 - DNA, 565 bp, Homo sapiens
  misc_feature: GZ8MTXP02G0ZF4.44.27.C05.1.454.CMB.2.raw
  modified_base (281)..(281): a, c, t, g, unknown or other
  modified_base (311)..(311): a, c, t, g, unknown or other
  modified_base (358)..(358): a, c, t, g, unknown or other
  modified_base (431)..(431): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaacttgtctctggtatcaacatcatccaggtaaacncccccaaatcatcatctatgagctataagngccctgagggtttcaatcgacttcacctgcctcaacgtccgacaacnccggcctcctgacatctcgtggctccgaggctggagacgaggctagatttagttattgttagcttcaaggttnttgttcgtcgactacttctatttagtcgttacgtagggtaacggtacggaccgtaacggtcctaccgttccgtacggtacaaccggacccaaccggacccctaacccgtacgtcgtacctaccgttccgtcccg

SEQ ID NO: 425091 - DNA, 584 bp, Homo sapiens
  misc_feature: GZ8MTXP02HTKJN.44.27.C05.1.454.CMB.2.raw
  modified_base (261)..(261): a, c, t, g, unknown or other
  modified_base (307)..(307): a, c, t, g, unknown or other
  modified_base (340)..(340): a, c, t, g, unknown or other
  modified_base (392)..(392): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagcgtggtttccgtcgttagccctcttaagaggtgtcatgtgtcaggtgcaattcgtggagtcgtgggggagcgtggccccaggtaggggggtccctggagactctccgtgngcagcctctggattccacctgataatggaatatgcaggtcggtccnccaggcctccgagggcggaggggtctgggaggnggggtgcgtaggtgtgtctagtttcagtggaagtaatcgtaagtcgtaggtntacgttccgtaggacggccattccacctatcctaccagacgaactaacgttccgaacgaaacacgagtcgtactacttacaatagaacagaccagacgaccgacgacgacgacgtacgtgttacgtttcgtagaccgtatacttatacttcgttaaccaaagttcgtactacgtcgtacgcgtcggacccgg

SEQ ID NO: 425092 - DNA, 573 bp, Homo sapiens
  misc_feature: GZ8MTXP02FJZCZ.44.27.C05.1.454.CMB.2.raw
  modified_base (421)..(421): a, c, t, g, unknown or other
  modified_base (426)..(426): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccgaggcgaggggctgggagtggggtggcgagggtgtgtcatttccagtggaaggaaatcaagtctacggtgatttccgtgagggccattcacatctccagagacaatccganaacanagtgtctacttacaaatgaacagacctgacgacctcgacggacacggccgtagttacgttttgtggtcgtaagtactacgttcttacggtttaccctaaaagttccggttactacgttaccgacggtcccgtacgggggaaccccgg

SEQ ID NO: 425093 - DNA, 576 bp, Homo sapiens
  misc_feature: GZ8MTXP02F356R.44.27.C05.1.454.CMB.2.raw
  modified_base (515)..(515): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccaggtaggggggtccctgagactctcctgtgcagcctctggattcaccttcgataattggaatatgcagtggtccgcaggctccaggcgaggggctgggagtggggtggcgaggtgtgtctagtttccgagtgggaaggaaatcgaaagttctacgggtgacgtttccggttgaggggtcccgtattccaccgactcctccaagacgacaacttaccgaagaacacagtcgtactacttacaaatagaacacgaccgtgacgacctcgagacgacgcgtgtatttgngcgtagactactctacgtttaccgaaacgttcggttactacgtcgtacgccgtcgggaccg

SEQ ID NO: 425094 - DNA, 642 bp, Homo sapiens
  misc_feature: GZ8MTXP02G9ULB.44.27.C05.1.454.CMB.2.raw
  modified_base (305)..(305): a, c, t, g, unknown or other
  modified_base (570)..(570): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtcgcagcctctggattcaccttgataattggaatatgacaggtcgggtcccncgaggcctccgaggccggaggggctgggaggtggggtggcgagggtgtggtctatttccgagtgggaaacgtaatcaaaggttctacggggtgtaacgtttcccggttaggacgggggtaccgtaatttcccgaaccctacttcctacccgagaacgaactaaacttacccggaagaaaccaccgaagtcgttaccttacttacctaaaagtacgaaacacgacctagacgacctcgagaccgacggtccgttagttacgtttgngtacgtagtacctagtacttcgttactaaaacgttcggttactacgtacgtaccgtccggtacgggacccgg

SEQ ID NO: 425095 - DNA, 698 bp, Homo sapiens
  misc_feature: GZ8MTXP02FGIRT.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccgaggcgaggggctggagtggggtggcaggtgtgtcatttcagtggaggaaatcaaagtctacgggtgagtttccgttagacggggtcccgaagttccgacctactcctacccgagaacgtaacaaactttcccggaaagaaaccaaacgagttacggttcctactttaccaaaagttacgaaaaccgtacgtacccgttaggaacggtaaccccttacgaaacgggaaccgaaccggggtaccccggttaggtttaaacgttttttcggtaggtaccggtaaacggtaaccgtttaacttaccgtttacggttttaaaccctaaaaacgtttacccggggtttactaacgttttaccggaaaccggtcccggtttaacccgggggg

SEQ ID NO: 425096 - DNA, 775 bp, Homo sapiens
  misc_feature: GZ8MTXP02FP9GD.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctggagactctcctgtgcagcctctggattcaccttcgataattggaatatgcaggtggtccgcaggctccgaggcgaggggctgggagtggggtggcgaggtgtgtctatttccgagtgggaaggtaaatcgaaagttcgtacgggtgtaacgtttccgggttagacggggtcccgtattcccaacccgtattacccgtacccgaaggaacgtaaccgtaaaacgttcccggaaagaaacccaacgtaacgttcgttaccttactttaaccgtaaaacgttacgaaaacctaacggtacccttacggaaccgtaaccccgttaacgaaccggggtaaccgtaacccggggttcccggtttaggttttaaacgttttttcgggtacggtacccggtaaaggttaaacctttacgtttaccgttttaacggtttttaaaacccccgtaaaaaggtttttcccggggtttaaccttaaaccggttttacccggtaaacccgggttcccggggtttaaccggggggtaaacccccggg

SEQ ID NO: 425097 - DNA, 654 bp, Homo sapiens
  misc_feature: GZ8MTXP02G3XJS.44.27.C05.1.454.CMB.2.raw
  modified_base (170)..(170): a, c, t, g, unknown or other
  modified_base (264)..(264): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggaggcgtggccccaggtaggggggtccctgagactctcctgtgcagcctntggatcaccttcgatatggaatatgcagtggtccgcaggctccgaggcggaggggctgggagtggggtggcaggtgtgtctatttccgagtggaagtaaatcaaagtctacgggtgtattccgggttagacgggtccagtttccaacctatcctacccaaggacaacctaaacttaccgaacgaaacacgtagtcgtaccttcttaacaaactagaaaccgtacgaccgtacgaacggaaccctacgaacggacccgaccgggtacccgttaggtttaacgtttttcggacggtacgtacgtaacttacgttaccgtttacggtttaaacctaaaacgtttcgggttacctaacgtttccggaaccggtccggtacgggggtaaccccgg

SEQ ID NO: 425098 - DNA, 715 bp, Homo sapiens
  misc_feature: GZ8MTXP02GJNIV.44.27.C05.1.454.CMB.2.raw
  modified_base (171)..(171): a, c, t, g, unknown or other
  modified_base (203)..(203): a, c, t, g, unknown or other
  modified_base (258)..(258): a, c, t, g, unknown or other
  modified_base (264)..(264): a, c, t, g, unknown or other
  modified_base (284)..(284): a, c, t, g, unknown or other
  modified_base (295)..(295): a, c, t, g, unknown or other
  modified_base (373)..(373): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgnggagtcgtgggggagcgtggccccaggtagggggtccctgagactctcctgtgcngcctcngatcacctgataatggaatntgcagtggccncagctcgaggcgagggctggagtgggtgcgtaggtgtgtctattcgagtggaaggtaaatcgtaaagtcgtacgggtntaacgtttcccggtaggaccgggggtacctaatttacccaaaccctactacccttaccgaaacgaacgtaaacccgtaaaacgttaccccggaaaagaaaccgaacctaggttacgttaacctttaccgtttaacgaaaaacttacgaaaaccgaaacggttaccgtaacgtaaccggaacccgtacggaacgggaaccgtaaccgggtaccgttacggtttaacgttttggttacggtaccggtaaagttaacgttactttacgttaacgtttaaaccgtaaaaacggtttccgttaacgtacgttaccggtaaccggtccggttacggggtaaaccccgg

SEQ ID NO: 425099 - DNA, 661 bp, Homo sapiens
  misc_feature: GZ8MTXP02IDJPA.44.27.C05.1.454.CMB.2.raw
  modified_base (295)..(295): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcagcctctggattctaccttgattaatggaatatgnagtcgggccgcgaggctccgaggcggaggggctgggaggtggggtggcgaggtgtgtctatttccgagttagggaaggaaagtcgtaaaggttcgttaccggggtgtaagtttccccggtttagggacgggggtcccgtatttcccgaccctactcctacccaaggaacgaactaaacgttaccgaagaaaccacgacgtgtccttacttacaaaagttagaaacacgacccgtagacgtacctcgaacgggacaccgggtccgttgtttacgttttggtacgcgtaagtacttagtaccgtttacgttaacctaaaacgttccggttaactacgtttacggccggtaccggtcggggaaccccgg

SEQ ID NO: 425100 - DNA, 591 bp, Homo sapiens
  misc_feature: GZ8MTXP02GGF2A.44.27.C05.1.454.CMB.2.raw
  modified_base (188)..(188): a, c, t, g, unknown or other
  modified_base (222)..(222): a, c, t, g, unknown or other
  modified_base (233)..(233): a, c, t, g, unknown or other
  modified_base (277)..(277): a, c, t, g, unknown or other
  modified_base (438)..(438): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaattgctctgtatcaacatcatccaggtaaacnccccaaatcatcatctatgaggcctataagcgccctcgaggggtttctaatcgcttcacctcgccttcaacggtcccgacaacgaccggtccctcccgtagactaactctcgtcggcctcgagctggagacgaggctgattattattgtgtctacgtagtnttcgttcgttcgacctattactaacgtttgtcggtttacgttacgggaaaaggttcgggaaccgtaaagggttccctaaacccggtctacggggtaccacggaccccgaacggacccctaacccacgttcgtaccttacgtcctttaaccccg

SEQ ID NO: 425101 - DNA, 544 bp, Homo sapiens
  misc_feature: GZ8MTXP02FHZ4L.44.27.C05.1.454.CMB.2.raw
  modified_base (344)..(344): a, c, t, g, unknown or other
  modified_base (489)..(489): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgccaggctccgaggcgaggggctgggagtggggtggcgaggtgngtcatttccatggaggaaatcaagtctacgggtgattccggttgagggcgattcaccatctccagagacaatccgaagaaacacagtgtctcttacaaatagaacagacctgagacctacacggacacggaccgtgttattttgngtcgagactatctgttaccaaaagttcggttacacttcgacgccgtcggggaccg

SEQ ID NO: 425102 - DNA, 669 bp, Homo sapiens
  misc_feature: GZ8MTXP02GPKDL.44.27.C05.1.454.CMB.2.raw
  modified_base (395)..(395): a, c, t, g, unknown or other
  modified_base (576)..(576): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtggtccgcaggcctcgaggcggaggggctgggaggtggggtggcgtagggtgtggtctagtttccgagttaggaaggtaaatcgaaagttcgtacggggttntaacgtttcccgggttaggaccggggtacctaagtttcccaacccgtattacccgtaccgaagaacggtaaacctaaacgttacccgaagaaacaccgtagttcgtaccttacttaacaaatcgaaacacgtactagacgacctacgaacggaccgtacggtccgttagtttacgttttgnggtacgtagtaacttacgttacgttacgtttaaaccgtaaaagtttccggttactaacgttccggaaccggtcccggtacggggtaaccccgg

SEQ ID NO: 425103 - DNA, 560 bp, Homo sapiens
  misc_feature: GZ8MTXP02FFVZZ.44.27.C05.1.454.CMB.2.raw
  modified_base (385)..(385): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtgggccgccaggctccgaggcgaggggctgggagtggggtgcaggtgtgtcatttcatgggaaggaaatcaaagtctaccggtgatccgttgagggccattcaccatcncagagacaatccgagaacacagtgtctctacaaatagaacagcctagacgacctcgagacacgggccgtgttattttgtgcgagactatctacgtttaccaaaattcgttactacgttccgacgccgtagggggccgacgggtaacccgtcggtaccaccggtcctccgtcccgg

SEQ ID NO: 425104 - DNA, 586 bp, Homo sapiens
  misc_feature: GZ8MTXP02HFYKD.44.27.C05.1.454.CMB.2.raw
  modified_base (417)..(417): a, c, t, g, unknown or other
tcagacagtatatacacgaccggtgctcgatttagacgcgatcgaaggatttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaatttgtctcctggtatcaacatcatccaaggtaaacgacccccaaatcatcatctatgagcctaataagacgcctagtagggttctaatcgtcttccactcgccctactaacgtcccggacaccgaccggccctcctagaactaactcctacgtcgggcctccgaggcnggaacgacgagggcctagatttagttattgttcgtctagtacgtattcggttcgtcgactactacctattagtcgttcgttaggtaacgtcgggaaaccaacgtccgtaaccgttccgtaggtcccgaacgaacccgaacgaacccaaccctacgtctacctactcccg

SEQ ID NO: 425105 - DNA, 622 bp, Homo sapiens
  misc_feature: GZ8MTXP02HAZND.44.27.C05.1.454.CMB.2.raw
  modified_base (380)..(380): a, c, t, g, unknown or other
  modified_base (395)..(395): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgacgactctcctgtgcagcctctggattcaccttcgataattggaatagtgcagtcgggtcccgcgaggcctccgaggcggaggggctgggaggtggggtggcgaggtgtgtctatttccgagtggaaggaaactnaagttcgtacgggtntaagttccggttagacggggtctacttcgaccacgtacctcagaacgacgtaaactaccgagaacacgagtcgtactactacaaatgaacacgcctagacgacctacgacgacgacggtcgtgtttacgttttgcggtaccgtagtacgttacttaccgtttacgtttaaccgtaaaacgttcgtttaaccgtacgttaccggtaccgtccggtacggggtacccgg

SEQ ID NO: 425106 - DNA, 595 bp, Homo sapiens
  misc_feature: GZ8MTXP02JLGTJ.44.27.C05.1.454.CMB.2.raw
  modified_base (150)..(150): a, c, t, g, unknown or other
  modified_base (370)..(370): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttntccctcttaagaggtgtcatgtgtcaggtgcaattcgtggagtcgtgggggaggcgtggccccgaggtacggggggtccctgagactctctgtgcagcctctggattccaccttcgataattggaaatatgcagtgggtcccgccaggctccaggccgaggggctgggagtggggtggcagggtgtgtcatttcagtggaggaaatcaaagtctacggtntatcgttgacggcgattcaccatctccagtacgactaataccgagaaacacacgtgtctctacctaaatagaacacgactagacgacctacgacgacgacggtaccgttcgttagtttagtgacgagactactacttacgttaaaccgttactacgttacgtactacgtaccgtacggtccggtacgggccggtaccggtaccgtccgtacccgtacccgtcccg

SEQ ID NO: 425107 - DNA, 736 bp, Homo sapiens
  misc_feature: GZ8MTXP02H4FFP.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctggagactctcctgtgcagcctctggacttcaccttcgattaagttggaatatgcaggtcgggtccgcaggctccgaggcggaggggctgggaggtggggtggcgtagggtgtggtctatttccgagttagggaggaaaatcgaaaggttcgtacggggttgtaacgtttcccgggttaggacgggggtcccgtaagtttcccgaccctactcctaccgaaggaacgaacctaaaacgtttacccgaacgaaaccgtaaccgtagttcgttaccttaccgtttaactaaaacgttacgaaaccgaacgtccccgtaagaccgtaacccgtacgaacgggtaccgaaccgggtacccgttaggtttaacgtttttggtacggtacggtaacggtaacgttacttaccgtttacggtttaaacccgtaaaacgtttccgggtttaaccgttacgttaccggtaacccggttcccggttacgggggtaaccccgg

SEQ ID NO: 425108 - DNA, 768 bp, Homo sapiens
  misc_feature: GZ8MTXP02IFUCD.44.27.C05.1.454.CMB.2.raw
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcaggtgggtccgccaggctccaggcgaggggctgggagtgggtggcagggtgtgtcatttcagtggaaggaaatcgaagtctaacggtgattccgtgagggccgattcaccatctccagagactaattccgaagaacacagtgtcctacttacaaatgaaaccagcctagacgaccctcgaggggaccaacggggcccgtttgttacgtttttggacgtaccgtaagtactacgtttacttacgttttaaccgtaaaaagtttccggtttactaacgtttccggtacccgtaccggttcgggggacccggtaaacccggggtaaaccccgttcggggttacccgtaccccggttacccttccccgttccccggggtaccccttacccccgaacccgaaaccgggggtaccccctaaccgttccccgggtttacccccgtttccccccgtcgggggtccccctcccccgttaccggccccgttacccgtaaccggggtaactacccgaaccccgttaccccggaaccggacggacccgaaccgaacccgggtacccgggtcccccgg

SEQ ID NO: 425109 - DNA, 526 bp, Homo sapiens
  misc_feature: GZ8MTXP02F13R3.44.27.C05.1.454.CMB.2.raw
  modified_base (189)..(189): a, c, t, g, unknown or other
  modified_base (236)..(236): a, c, t, g, unknown or other
  modified_base (285)..(285): a, c, t, g, unknown or other
  modified_base (364)..(364): a, c, t, g, unknown or other
  modified_base (381)..(381): a, c, t, g, unknown or other
  modified_base (438)..(438): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaaatnttcttagtcttaactttgtctcctggtatcaacatcatccaggtaaacncccccaaactcatcatctatgagcctataagagccctcaggggtttctaatcgcttcacctgcctcaagtccgacaacncgcctcctgacatctcnggctcagctgaggacgagctgtatttattattgttagctactagtattgttcggtcncctatctacttatgttctacggaagttcggactaaggtcaccgtcctacggtcacgacccaaggcccaacccactcgtccactctccc

SEQ ID NO: 425110 - DNA, 640 bp, Homo sapiens
  misc_feature: GZ8MTXP02GDVKA.44.27.C05.1.454.CMB.2.raw
  modified_base (188)..(188): a, c, t, g, unknown or other
  modified_base (224)..(224): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtggacnccagcggtaattattcttagtcttaacttgtctctgtatcaacatcatccaagtaaacgacccccaaactcatcatctatgagcctaataacgacggccctacgtacggggtttactaaagtcgtcttcaccctcgcccttacgaaacgtcccggaccaaccgaccggtccctccctagaaccctaactctcgtcgggtcctccgacggtctaggacggtacgagcgtagtaagttattagttggttctctacgtagtattggtttacgtcgtactaatcgtaactttatcgttacgttcgggtaaagttacgggaaccgtaaaaggttcccgtaaaccggttccgtaacggttacccacgaacccgaaaccgggaccccaaacccgtaccgtcgtacccacttccctttaccccg

SEQ ID NO: 425111 - DNA, 567 bp, Homo sapiens
  misc_feature: GZ8MTXP02FKJOR.44.27.C05.1.454.CMB.2.raw
  modified_base (337)..(337): a, c, t, g, unknown or other
  modified_base (383)..(383): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccaggtacgggggtccctgagactctcctgtgcagcctctggattcaccttcgataattggaatatgcaggtgggtccgcaggctccgaggcgaggggctgggagtggggnggcgaggtgtgtcatttccagtggaagaaatcaaagttctacggtnatttccggtgacgggtccgattccacatctccagagacaatccgaagaacacagtcgtctcttacaatgaacagcctgacacctcgaggaccgacggtccgtgttacgttttgcgtacgagtactactcttacgtttaaccaaaacgttcggttactacgttccgacgtccgtacggggacccg

SEQ ID NO: 425112 - DNA, 576 bp, Homo sapiens
  misc_feature: GZ8MTXP02GQ0LN.44.27.C05.1.454.CMB.2.raw
  modified_base (213)..(213): a, c, t, g, unknown or other
  modified_base (334)..(334): a, c, t, g, unknown or other
  modified_base (341)..(341): a, c, t, g, unknown or other
  modified_base (358)..(358): a, c, t, g, unknown or other
  modified_base (368)..(368): a, c, t, g, unknown or other
  modified_base (502)..(502): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcactttcagtaacgcctggatgacctgggtccnccaggctccgagggagggctggagtgggttgcgtatagaaccaagctgacggtgggacagcagactacgctgcacccgtgaaaggcagattcaccatctacaagagatgaattacaaaagntacggtntctctgcagatagaacngcctagaacnccgagacacgacgcccgttatattactgtcgtgggtattggtttcagttcgggcccaacgggtacccgtggtcctaccgttctcccgtcacgccctaccgaaccgaacgggcccctagtcccgtccttccccgngccgccctcgcctccgaggtcgacctaccgtccgacgcgccaacgacgcccggcccgtgggcctcgaccgtcgg

SEQ ID NO: 425113 - DNA, 592 bp, Homo sapiens
  misc_feature: GZ8MTXP02JBGBA.44.27.C05.1.454.CMB.2.raw
  modified_base (402)..(402): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcagtggtccgccaggctccaggcgaggggctgggagtggggtggcaggtgtgtcatttcatggagaaatcaagtctacggtgattccgtgaggggcattcaccatctccaganacaatccgagaacacagtgtctctacaaatgaaacagccctagacgaccctcgaacggacgaacgggtccgttaggttaactttttggtggtacgtaaggtaaccttagttaccttaggtttaaccctaaaaagtttccgggtttactaacgtttccggtaaccggtacccggttcgggggtaaccccgg

SEQ ID NO: 425114 - DNA, 634 bp, Homo sapiens
  misc_feature: GZ8MTXP02HKZW5.44.27.C05.1.454.CMB.2.raw
  modified_base (296)..(296): a, c, t, g, unknown or other
  modified_base (311)..(311): a, c, t, g, unknown or other
  modified_base (348)..(348): a, c, t, g, unknown or other
  modified_base (453)..(453): a, c, t, g, unknown or other
  modified_base (458)..(458): a, c, t, g, unknown or other
  modified_base (466)..(466): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtcgcagcctctggacttcaccttcgataattggaatntgcaggtcgggtccncagggcctccgaggccggaggggctgggaggtggggnggcgtagggtgtgtctatttcagttggaagtaaatccgaaagtcgttaacggtgtatttccgggtagacgggctattccacactctcgagacaactaactcgaanaacanagtgtctntacgtaaatcgaactacgccgtagacgtaccgtcgaacggtacaacgggtcccgttaggtttagtttttggtacggttaggtaaacttccgttaaactttcgttacggtttaaacctaaaacgtttccggttactacgtttccggtaacggttcccggtaaccggggg

SEQ ID NO: 425115 - DNA, 682 bp, Homo sapiens
  misc_feature: GZ8MTXP02I4TWM.44.27.C05.1.454.CMB.2.raw
  modified_base (605)..(605): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtcggccccgaggtacgggggtccctggacgactctcctgtgcagcctcgtggattcaccttcgaataagttggaatatgcaggtcgggtcccgcgaggctccgaggcggaggggctgggagtgggtggcgtagggtgtgtctagtttccagtagggaagtaaatcaaaggttctacggggttgtacgtttccgggtttaggacggggtaccgtacgtttacccaccctagttccctacccgtaaggtaacgtaaccctaaaacgttcccgaaagtaaaccgaacgtacgtcgttaccttacttaaaccaaagttacgaaacgtacgacccgttaacgacggacccttacgaacgggacctaacgggtccgttgtttaacgtttggngtaccgtagtacttacgttcgttacgttaactaaacgttcggttactacgtttcggaccgtccggttacggacccgg

SEQ ID NO: 425116 - DNA, 659 bp, Homo sapiens
  misc_feature: GZ8MTXP02GRQ9G.44.27.C05.1.454.CMB.2.raw
  modified_base (271)..(271): a, c, t, g, unknown or other
  modified_base (274)..(274): a, c, t, g, unknown or other
  modified_base (282)..(282): a, c, t, g, unknown or other
  modified_base (289)..(289): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtcccctgagactctcctgtgcagcctctggattcaccttgataatggaatntgnagtggccncgaggcnccgaggcgaggggctgggagtggggtgcgagggtgtgtctatttcagtgggaagaaatcgaagttcgtaacggtgtacgtttccggtaggacggggaccctattcccgaacctatcctaccgaagacaactaacttaccgagaaacacagtctctactacaaatacgaacacgacctagaacgacctacgacggaccgtaccgggtccgtagtttacgttttgtacgacgtagtaacttacttcgtttacgtttaacctaaaacgtttccgttacctacgttaccggaccggtacccggtacgggggaacccggtaacggggtaaccccgttcggtaccccgtcccggtacccgttacccgtcccccggg

SEQ ID NO: 425117 - DNA, 578 bp, Homo sapiens
  misc_feature: GZ8MTXP02IIK9V.44.27.C05.1.454.CMB.2.raw
  modified_base (236)..(236): a, c, t, g, unknown or other
  modified_base (514)..(514): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccccgactcagcctgcctccgtgtctgggtcgccctggacagtcggtcaccatctcctgcactggagccagcggtaatnttcttagtctttaactttgtcttcctggtatcaacatcatccaaggtaaacgacccccaaatcatacatctatgacgactaagtaagcggccctgtagggtttactaatcgcttcactccgacctaccacgtccgacaaccgcgccctcctacgaactactcctcgtcggctcgaaggctaggacgacggaagtctagtaatttattagttgttgctgtaagtcttgttacgtcgactatctattagtgtcttacgggaatacgggtacagggttccnccgttaacgtgtaccacgacccgtaacgaaccccaaactcgtagaccctctccgtcttcccccg

SEQ ID NO: 425118 - DNA, 525 bp, Homo sapiens
  misc_feature: GZ8MTXP02FLZ1E.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggcccccagtagggggtccctgagactctcctgtgcagcctctggattcaccttcgataattggaatatgcagtggtccgcaggctccaggcgaggggctgggagtgggtggcaggtgtgtcatttcatggaggaatcaagtctacggtgattccgttgaggccattcacatctcagagacattccgagaacacagtgtctcttacaaatgaacagccctgacgacctcaggacacggcctgtattttgtgcgagactagtcttagttaacaaatcggttcacgttcgacgtcgtacgggg

SEQ ID NO: 425119 - DNA, 789 bp, Homo sapiens
  misc_feature: GZ8MTXP02FJFK4.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctggagactctcctgtgcagcctctggattcaccttcgataattggaatatgcaggtcggtccgccaggctccgaggcgaggggctgggagtggggtggcgagggtgtgtctagtttccagtaggaggaaatcgaaagttctacgggtgtacgtttcccggttagggaacggggtcccgtaagtttacccgaacccgtacttacccgttacccgaaacggtaacggtaaaccctaaaacgtttaccccggaaacgtaaaacccgaacgtaaacggttcggttaccctttaccgtttaaaccaaaacgtttacggtaaaacccgacggtaccccgttacggaaaccggtaacccccgttaacggaaacgggtaacccgaacccgggggttaccccgtttagggttttaaacgttttttcgggtacgggtaacccggtaaggttaaaccttacgtttaccgttacgtttttaaaacccgaaaaacgttttccgggtttaactaacggtttacccggaaccggtccccggtacgggggtaaacccccggg

SEQ ID NO: 425120 - DNA, 618 bp, Homo sapiens
  misc_feature: GZ8MTXP02I8WL9.44.27.C05.1.454.CMB.2.raw
  modified_base (320)..(320): a, c, t, g, unknown or other
  modified_base (330)..(330): a, c, t, g, unknown or other
  modified_base (334)..(334): a, c, t, g, unknown or other
  modified_base (371)..(371): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtagggggtccctgagactctcctgtgcagcctctggattcaccttcgataattggaatatgcaggtggtccgccaggctccaggcgaggggctgggagtgggtgcaggtgtgtcatttcagtggaggaaatcaaagtctacggtgattccggtgagggccgtattccacatctaccaganacaattcganaacncaagtcgtctctacaaatcgaacacgctgacaccctnacgacacgggtccgtagttatttttgagcgaagacttatctagtttacccaaaagttcggttactattcgaccgcgtcggggccaacgggaaccgtcggtccgacccgtcctcccgtccggtccctccgaccgaaaccggggccctaacgtcccggttccttacccccgtggcccgtccccgtcgccgtccgaacggtcgaccgaacccgtcccggaacgaccgtacaccgtacgggcccgtcccgg

SEQ ID NO: 425121 - DNA, 627 bp, Homo sapiens
  misc_feature: GZ8MTXP02IW3CD.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggcccgagtaggggggtccctgagactctcctgtgcagcctctggattcaccttcgataatggaatatgcaggtcgggtccgcgaggctccgaggcggaggggctggaggtgggtggcaggtgtgtcatttccagtaggagaaatcgaagttctacggtgtagttccgtggacgggtccgtagtttcccacctatacctaccgaaggtaacgaaactaacgttcccgaaagaaaccaaccgtagtacgttccttacgttaccaaaattagaaacacggtacctagacgactcgacggacacgtaccgttagtttacgttttgtagtacgtacgtaacttcgttaccgttagtttaccctaaaagtttcggttactacgttacggaccggtccgttacgggggacccg

SEQ ID NO: 425122 - DNA, 603 bp, Homo sapiens
  misc_feature: GZ8MTXP02IN3DN.44.27.C05.1.454.CMB.2.raw
  modified_base (297)..(297): a, c, t, g, unknown or other
  modified_base (374)..(374): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtaggggggtccctgagactctcctgtgcagcctctggattcacttcgataatggaatatgcagtggccncagctccaggcgagggctggagtggggtgcaggtgtgtctagtttccagtggaaggaaaatcaaagtctacggggtntacgttcggtagacgggtctattaccactatctacgagacgaactaacgtaccgaagaacaacgagtacgtactacttaaacaaatacgaaactacgacctagaacgtaccgtacgacggacgacggtcgttagtttacgtttgtacgtacgtaacgtacttacgttacgttacgttaaacgtaaaacgttcggttacgtacgttacggaccgtaccggtacgggaccg

SEQ ID NO: 425123 - DNA, 699 bp, Homo sapiens
  misc_feature: GZ8MTXP02JQ766.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctggagactctcctgtgcagcctctggattcaccttgataattggaatatgcaggtcgggtcccgcgaggcctccgaggcggaggggctgggaggtggggtggcgagggtgtgtctatttccgagtgggaaggaaatcgaagttcgtacgggtgtagtttccggtggacggggtccgtattcccgaccgtactcctaccgaaggacgaacgtaaacgttacccggaaacgtaaaccgacgtacgttcgttaccttacctttaacctaaaacgttaccgaaacgtacgtacccgtacggaaccgtaacccgtacggaacgggaacccgaccgggtaccgttacggtttacgtttttggtacggtaccggtaggtaaccttacgttccgtttaacgtttaaccctaaacgtttccggttactacgttaccggtaccggtcccggtacggggtaacccgg

SEQ ID NO: 425124 - DNA, 688 bp, Homo sapiens
  misc_feature: GZ8MTXP02FY7O9.44.27.C05.1.454.CMB.2.raw
  modified_base (203)..(203): a, c, t, g, unknown or other
  modified_base (265)..(265): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgnggagtcgtgggggaggcgtggccccaggtagggggtccctgagactctcctgtgcagcctcnggattcaccttcgataattggaatatgcaggtggtccgcaggctccgaggcggaggggctgggaggtggggtggcgtagggtgtgtctatttccgagttgggaaggaaatcgaaaggttcgtacggggtgtaacgtttcccggttaggagggggtacccgtatttacccgaaccctacgttccctaccgaaggacgtaaactaaaccgtaccgaaagaaacctacgtagtacgttaccttactaaactaaacgtacgaaacacgtactacgacgtaaccgacggaacggaccgaccggtcgttaggttttacgtttggacgtcggtaaacttaacgttacgtttaccgttacgtttaaaacctaaaacggttccggttaacttacggtaccggtaccggtcccggggttacgggaaccccggg

SEQ ID NO: 425125 - DNA, 638 bp, Homo sapiens
  misc_feature: GZ8MTXP02FN7ZU.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtcgggtccgccaggctccgaggcgaggggctgggagtggggtggcgaggtgtgtctatttccgagtggaaggaaatcgaaaggttcgtacggggtgtaactttccggttaggacggggtcccgtatttacccaacccgtatacccgtacccgaagaacgaaccgtaaacttacccgaagaaaccgaaccgtaagttcgttaccttctttaaccaaaagttacgaaacacgtacctacgacgacctacgaacggacgacgaccgttagttagttttgagtacgagtactattcgtacgttacctaaaagtcggttactacttacgaccgtaccgtcgggtacccgg

SEQ ID NO: 425126 - DNA, 560 bp, Homo sapiens
  misc_feature: GZ8MTXP02FUW45.44.27.C05.1.454.CMB.2.raw
  modified_base (188)..(188): a, c, t, g, unknown or other
  modified_base (360)..(360): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtcttaacttgtctcctggtatcaacatcatccagtaaacgcccccaaactcatcatctatgagcctataagagccctgagggtttctaatcgcttcactgcctacaagtccggacaacnccggcctcctgacaatctctgggctcgagctgaggacgagctgtattattattgttagctcagtattgttcgtcgctatctactttatcgttacgttacggaagttacgggaaccgtaaaggtccaccggttaccgtacggttaccacgaccccgaaacggaccccaaaccccgtacgtcgtaccaccgttctttccccg

SEQ ID NO: 425127 - DNA, 571 bp, Homo sapiens
  misc_feature: GZ8MTXP02GEZ0Z.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataatggaatatgcagtggtccgcaggctccaggcgagggctggagtgggtggcagggtgtgtcagtttcagtggaaggaaatcgaaagtcgtacggtgtagtttccgtgaacgggccgtattccgaccatcctaccagagacaacttacgaagaacacagtacgtactacttacaaatagaaacagacctgacacctacgaggaacacggccgtgttagttttgtcgacgtacgtactatcttacgttaacctaaaagttcggttactacgttacgacgtccgtacgggg

SEQ ID NO: 425128 - DNA, 617 bp, Homo sapiens
  misc_feature: GZ8MTXP02ITNU6.44.27.C05.1.454.CMB.2.raw
  modified_base (272)..(272): a, c, t, g, unknown or other
  modified_base (403)..(403): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctggagactctcctgtgcagccctntggattcaccttcgataattggaatatgcaggtgggtcccgccgaggcctccgagggcggaggggtctggggaggtggggtggcgagggtgtgtctagtttcgagtgggaagaaatcgaagtcgtagggtntacgttccgtggacggcctatccaccatctcagtagactaactaccgaagaacacgtagtacgtcttactactaaactacgaacacgacctagaacgtacctcgacggaccgacggtccgttagttcgttttggtacgtcgtaacgtactacgttacgttacgttaaccgtaaaacgttcgttactacgttacggtaccgtaccggtaccgggg

SEQ ID NO: 425129 - DNA, 672 bp, Homo sapiens
  misc_feature: GZ8MTXP02GKXSD.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataagttggaatatgcaggtcgggtcccgcctaggcctccgaggcggaggggctgggagtggggtggcgaggtgtgtctattcgagtgggaaggaaattcgaaagttcgtacggggtagtacgtttccgggtaggacggggtaccgtattccgtaaccctactccgtacccaggacgaactaaacgttaccgaagaaacgaaccgagtcgtactacttactaaactagaacacgtacgtacgacgacccgtacgaacgggaccgtaaccgggtccgttacggtttacgttttggtacggtaccgtaaggtacttacgtacgttacgtttaaccgtaaaacgttccgggtttaactacgttaccggtaccggtcccggtacggggtaaccccgg

SEQ ID NO: 425130 - DNA, 583 bp, Homo sapiens
  misc_feature: GZ8MTXP02G0Y1O.44.27.C05.1.454.CMB.2.raw
  modified_base (266)..(266): a, c, t, g, unknown or other
  modified_base (364)..(364): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaactttgtctctggtatcaacntcatccaggtaaacgcccccaaatcatcatctatgagcctataagaggccctcgagggtttctaatcgacttcacctgcctacaacgtccggacaacnccggcctcctgaccaatctacgtcgggctcgaggctggagacgagctagattatattgtagctcagtatcgttcgcgctagtctacttagtcgttacgttacgggaagttcggggaaccctaaagggtccgtaaccccggttccgttacgggtaccaacggaccccgaaacgggcccccaaaacccctacgtaccggtacctaccggtacctttccccg

SEQ ID NO: 425131 - DNA, 610 bp, Homo sapiens
  misc_feature: GZ8MTXP02I1P5T.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctggagactctcctgtgcagcctctggattcaccttcgataatggaatatgcaggtgggtcccgccgaggcctccgaggcggaggggctgggaggtggggtggcgagggtgtgtctatttccgagtggaagaaatcaaaggttctacgggtgtagttccggttgacggggtcctattccgaccactcctaccgaagagaacctaagtccgaagaacacagtgtactacttacaaatgaaacacgcctagacgacctcgaacggacacgggtccgttagttaacgttttgtcgacgtagtaaccttagtacttacgttaactaaaagttcggttactacgttccgacgtccggacggggtaacccgg

SEQ ID NO: 425132 - DNA, 684 bp, Homo sapiens
  misc_feature: GZ8MTXP02IK8A4.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcacatggagtttgggctgagctgggttttcctcgttgccctcttaagaggtgtcatgtgtcaggtgcaattcgtggagtcgtgggggagcgtggccccaggtagggggtccctgagctctcctgtgcagcctctggattcaccttcgaataattggaaatatgcaggtcgggtcccgccaggcctccgagggccggaggggctgggaggtggggtggcgagggttgtgtctatttcgagttgggaaagtaaagtacgtaaaggttccgtaaacgggcgtaacgttttcccgggtaggacgggggaccctacgtttaccgaccctaagtccctaccgaacggaacgtacctaaacgtttacccgaaacggaaaccacgtaacgttcgttaccttacctttaacaaaagtacgaaacgacgtccgtacgaacgtaccctacgaaccggaccgaaccgggtccgttagtttacgttttgacgtaccggtatacgtacttaccttacgttaaaccgtaaacttccggttactacgtttccgaccgtcggtaccgggg

SEQ ID NO: 425133 - DNA, 557 bp, Homo sapiens
  misc_feature: GZ8MTXP02F2ARB.44.27.C05.1.454.CMB.2.raw
  modified_base (396)..(396): a, c, t, g, unknown or other
  modified_base (405)..(405): a, c, t, g, unknown or other
  modified_base (463)..(463): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcaggtgggtccgcaggctccgaggcgaggggctggagtggggtgcgaggtgtgtcatttcatggagaaatgaagtctacggtgattccgtgaggccgattcaccatcaccagagacatcganaacacagtntctacgtacaaatgaacacgacctagacgacctacgagacacggcgtcgttatttcgngtacgagtactatcttacgttacctaaaagtcgttacactcgtacgccggtcgggaaccgacggaacccgtcggtccgaccgtcctccgtcccg

SEQ ID NO: 425134 - DNA, 632 bp, Homo sapiens
  misc_feature: GZ8MTXP02I40P7.44.27.C05.1.454.CMB.2.raw
  modified_base (267)..(267): a, c, t, g, unknown or other
  modified_base (304)..(304): a, c, t, g, unknown or other
  modified_base (566)..(566): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctcnggattcaccttcgataattggaatatgcagtggtccncaggcctcaggcgagggctggaggtgggtggcagggtgtgtcatttccgatgggaagaaatcgaagttcgtacggtgtacttccggttgacggggtccgtaatttccaaccgacttcctccgaacggtaacgaacctaaagttcccgaagtaaaccgaacgtagttcgttaccttaccttaccaaaattacgaaaccacggacccttagaaccgtacctacgaacggacccgaacgggtacccgttgtttaacgtttttggnggttcgagtacttatcttgttaaccaaagttcggttactacgtccgacgtccgtcggggtaacccg

SEQ ID NO: 425135 - DNA, 696 bp, Homo sapiens
  misc_feature: GZ8MTXP02I3TGX.44.27.C05.1.454.CMB.2.raw
  modified_base (282)..(282): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctggggaggcgtggccccagtagggggtccctgagactctcctgtgcagcctctggattcaccttgataattggaatatgcagtgggtccnccaggctccgaggcggaggggctgggagtggggtggcaggtgtgtcatttcagtagggaggaaatcgaaagtctaccgggtgtattccggtaggacgggccctagttccaccattcctaccagaagacctaattacccgagaacacagtcgtctacgttacaaaatacgaacacgcctagaacgaccctcgaacggaccgtaccgggtcccgttagtttaacgtttttggtacggtacggtaacggtaaaccttacgtttaccgttaacggttttaaaccctaaaaacggtttccgggtttaaccttaacgtttacccggaacccggtcccggtacccgggggtaacccgtaaccgggggtaaaacccccgttcggggttaccctaacccggttcccgttaccccgtcccccgg

SEQ ID NO: 425136 - DNA, 553 bp, Homo sapiens
  misc_feature: GZ8MTXP02HODM1.44.27.C05.1.454.CMB.2.raw
  modified_base (188)..(188): a, c, t, g, unknown or other
  modified_base (314)..(314): a, c, t, g, unknown or other
  modified_base (359)..(359): a, c, t, g, unknown or other
  modified_base (367)..(367): a, c, t, g, unknown or other
  modified_base (423)..(423): a, c, t, g, unknown or other
  modified_base (447)..(447): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatattcttagtctttaacttgtctcctggtatcaacatcatccaggtaaagcccccaaaatcatcatctatgagcctataagnggccctgagggtttctaatcgcttcacctcgcctcagtcgcaacncgcctccngacatctctcggctccagctgaggcgagctgatttattagttgtacgctcgagttntggttcgtcgcctattcaactttntggttcgttcgggaagttacggggacctaagggtccaacccggttctaacgggtcaacggtacccaacgggcccaaacccctcgtacgtacctacttccgttcccg

SEQ ID NO: 425137 - DNA, 622 bp, Homo sapiens
  misc_feature: GZ8MTXP02FS3S4.44.27.C05.1.454.CMB.2.raw
  modified_base (300)..(300): a, c, t, g, unknown or other
  modified_base (373)..(373): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtaggggggtccctgagactctcctgtgcagcctctggattcaccttcgataattggaatatgcagtggtccncaggctccgaggcgaggggctgggagtggggtggcaggtgtgtcatttcatggaggaaatcaagtctagggtnactttccggttgacgggtccgattcaccatctcagagacaactaccgagaacacagtgtactcttacaaagtagtaacacgccgtagacgaccctcgacgggaccgaaccgggtcccggttagtttaagtttttcggtacggtacggtaacgtaccgttacttaccgttacgttttaacccgtaaaaacgtttccgggtttaactaccgtttaccggtaaccggtcccggttaccgggggtaaccccgg

SEQ ID NO: 425138 - DNA, 560 bp, Homo sapiens
  misc_feature: GZ8MTXP02GAMOC.44.27.C05.1.454.CMB.2.raw
  modified_base (223)..(223): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcgtaatattcttagtcttaactttgtctcctggtatcaacatcatccaaggtaaacgcccccaaactcatcatctatgagcctataagagccctcgtaggggtttctaatcgcttcacctgcctcacgtccgacaacaccggcctcctgacactctcgtagggctccgagcgtgacggacgagctgtattattattgttgctcagtagtgttcgcgctatctacttattgttcgttacggtaaggtacgggacctaagggtcctacccgttccgtacggtcgacgacccgaacggaccccaacccctacgtcgtaccaccttccgtttccccg

SEQ ID NO: 425139 - DNA, 620 bp, Homo sapiens
  misc_feature: GZ8MTXP02F1CEB.44.27.C05.1.454.CMB.2.raw
  modified_base (404)..(404): a, c, t, g, unknown or other
  modified_base (506)..(506): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacgggggtccctggacgactctcctgtcgcagcctcgtggtattccaccttcgataattggaatatgacaggtcggtccgccgaggctccgaggcggaggggctgggaggtgggtggcgtagggtgtgtctatttccgagtgggaagaaactcgaaagttcgtgggtntacgttccggtgagggtcctatccacctatcctacgaagagaactagtaccgaagaacacgtagtcgtactactacaatgtaacacgtccgtagacgtaccncgtacggacaccggtcgttacgttatttaggcgtacgtagtacttacgtacgttacgttaaccgtaaaagttccgttactacgttccggaacgtcccggtacggggtaacccgg

SEQ ID NO: 425140 - DNA, 797 bp, Homo sapiens
  misc_feature: GZ8MTXP02G2E6S.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataatggaatatgcagtgggtccgcaggctccaggcgaggggctgggaggtggggtggcagggtgtgtcgatttccgagtggaaggaaaatcgaaaggttctacggggtgtacgtttcccggtttggaacgggggtccccgtagtttacccgaacccgtaacttcccgttacccaacggaacggtaaaccctaaaacgtttaccccggtaaaacggaaaaccaaacccgtaaagttccggttaccgtttacccgtttttaaacccgaaaaatttaccgggaaaaccaacgggtacccccgttaaggtaaaccggaacccccgttaacgaacggggtaaaccccgaaaccggggtccccggtttaggtttaaacggttttttccggttaaggtccgggtaaacggtaaacctttaacgtttacccgtttacgggttttaaacccctaaaaaaggtttcccggtttaaaccgtaaccgtttccggaacccggtcccggggttaacgggggtaacccccgggg

SEQ ID NO: 425141 - DNA, 554 bp, Homo sapiens
  misc_feature: GZ8MTXP02FGMHV.44.27.C05.1.454.CMB.2.raw
  modified_base (170)..(170): a, c, t, g, unknown or other
  modified_base (263)..(263): a, c, t, g, unknown or other
  modified_base (303)..(303): a, c, t, g, unknown or other
  modified_base (335)..(335): a, c, t, g, unknown or other
  modified_base (344)..(344): a, c, t, g, unknown or other
  modified_base (493)..(493): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggagcgtggccccaggtaggggggtccctgagactctcctgtgcagcctntggattcaccttcgataattggaatatgcaggtgggtccnccaggctccgaggcgaggggctgggagtgggnggcaggtgngtcatttccagtggagaatcaagtctacggtgactttccgtgagggtccgattccaccatcctaccagagacaatccgaagaacacagtgtctcttacaaatgaacagacctgacgacctacgacggacacggtccgtgttacttttgngacgagtactactctacgttaccaaaagttcgttactacttcgacgtccgcggggtacccg

SEQ ID NO: 425142 - DNA, 590 bp, Homo sapiens
  misc_feature: GZ8MTXP02JGXGN.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctggggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcaggtgggtccgccaggctccgaggcgaggggctgggagtggggtggcaggtgtgtctatttccagtgggagaaatcgaagttctacgggtgagtttccggttgacggggtccgattccacctatcctccagtagacaattccgagaacacagtgtctctacaaatagaacagcctagacgacctacgacggaccgacgggccgtagttacgttttgagtccgtagtacctacgtaccttacgtttaccctaaaagttccggttactaacgttccgaaccgtccgtacgggggaccccg

SEQ ID NO: 425143 - DNA, 573 bp, Homo sapiens
  misc_feature: GZ8MTXP02IVI05.44.27.C05.1.454.CMB.2.raw
  modified_base (380)..(380): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtcccgcaggctccgaggcgaggggctgggagtggggtggcgaggtgtgtctatttccagtggagaaatcaagttcacgggtnattccgttgacggggctattcaccatctcagagacaattccgaagaacacagtgtctacttacaaatgaacagacctagacgacctacgaacggtaccgaccggtccgtagtttagttttggtgtacgtaagtacttacgtacttcgtttacctaaaagttcggttactacgttcgacgtccgtcgggtaccg

SEQ ID NO: 425144 - DNA, 635 bp, Homo sapiens
  misc_feature: GZ8MTXP02IL8SY.44.27.C05.1.454.CMB.2.raw
  modified_base (334)..(334): a, c, t, g, unknown or other
tcagacagtatatacacgaccggtgctcgatttagacgcgatcgaagggtttggggcctgggagacgagcccagcactggaagttgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctctggacttcaccttcgataattggaatatgcaggtcggtccgccaggctccgaggcggaggggctgggngtggggtggcgaggtgtgtctatttccgagtggaagtaaatcgtaaaggttctacggggtgtactttccgggttagacggggtccgtattccacctatcctccagacgaactaactaccgaagaacacgagtgtacttacttaacaaagtacgaacacgacctacgacgacccgtacgacggaccgtaccggtacgttagtttagttttcggtgacgtaacgtacttacttacgtttacgtttaaccgtaaaacgttcggttacttacgttaccggaccggtccggtaccggggtacccgg

SEQ ID NO: 425145 - DNA, 617 bp, Homo sapiens
  misc_feature: GZ8MTXP02I7CUV.44.27.C05.1.454.CMB.2.raw
  modified_base (392)..(392): a, c, t, g, unknown or other
  modified_base (485)..(485): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagctctcctgtgcagcctctggattcaccttcgataattggaatatgcaggtcgggtcccgccgaggcctccgaggcggaggggctgggaggtggggtggcgagggtgtgtctatttcgagtggaagaaatcgaagtcgtacgggtntacgttccggtagacgggtccgtattccactactcctaccgagacgaactaactaccgaagaacacgtagtcgtactacttacaaatgaaacncgacctagacgacctacgaacggaccgtacggtccgttagtttacgttttcggacgtacggtagtaacttacgttcttacgtttaacaaagtttcggttactacgttacggaccgtcggtacgggaacccgg

SEQ ID NO: 425146 - DNA, 760 bp, Homo sapiens
  misc_feature: GZ8MTXP02GAUB2.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttgataattggaatatgcagtcggtccnccgaggcctccgaggcggaggggctgggaggtggggtggcgtaggtgtgtctatttcagtggagaaatcgaagtcgtacgggtgacgtttccggttggacggggtccgtaatttcccgaaccctacttacccgtacccgaaggaacggtaaacctaaacgtttaccccggaaaggaaacctaaccgtaacggttcggttaccttacctttaacaaaacgtttacggaaaacctaacggtaccccgttaaggaaccgtaaccccgttacggaaaccgggacccgtaaaccggggtcccggtttacggttttaaacgttttttaggtcgggtacccggtaaaggttaacctttaacgtttaccgtttaacgtttttaaaccccgaaaaacgttttcccgggtttaacctaacgtttacccgggtaaccggttcccgggtttaccgggggtaaacccccgg

SEQ ID NO: 425147 - DNA, 611 bp, Homo sapiens
  misc_feature: GZ8MTXP02JVPXC.44.27.C05.1.454.CMB.2.raw
  modified_base (190)..(190): a, c, t, g, unknown or other
  modified_base (224)..(224): a, c, t, g, unknown or other
  modified_base (236)..(236): a, c, t, g, unknown or other
  modified_base (285)..(285): a, c, t, g, unknown or other
  modified_base (425)..(425): a, c, t, g, unknown or other
  modified_base (468)..(468): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcatgcctccgtgtctgggtcncctggacagtcggtcaccatctcctgcactgganccagcggtaatnttcttagtcttaacttgtctcctggtatcaacatcatccaaggtaaacncccccaaatcatcatctatgaggcctaataagcgtccctgtaggggtttctaagtcgtcttaccactgcctaccaacgtccggacaccgaccggcctcccgtagaacaactctacgtcgggctccgaggctaggagacgnggctagtatttattagttgttgctcgaagtcttggttcgcgtntaacttctaacttagttgttacggttaccggtaaaggttacggggaaacctaaacgggttcccgtaacccggttacgtaacggttccaaccggaacccgaaaaccggcccccaaaaccctcgtaaccgtcctacctttccccg

SEQ ID NO: 425148 - DNA, 686 bp, Homo sapiens
  misc_feature: GZ8MTXP02GXY56.44.27.C05.1.454.CMB.2.raw
  modified_base (316)..(316): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggcccccagggtacggggggtccctggacgactctcctgtcgcagcctgtggattccaccttcgattaattggaatatgctaggtcgggtcccncaggctccgaggcggaggggcgtgggaggtggggtggacgtagggtgtgtctatttccgagtgggaagaaacttcgaaagtccgtaggggtgtaacgtttcccggttaggacgggccgtattcccgacctactcctaccgaagaacgaactaaacgttacccgaagaaaccacgtagtcgtaccttactaactaaaacgtcgaaacgtacggaccctagaaacgtaccacgaacggaccgtaacgggtcgttacggtttaacgttttggtacgtacgtaacggtaaacttacttacgttacgtttaaaccgaaaacgtttccggtaaccttacgttaccggaccgtacccggttacgggggtaaccccgg

SEQ ID NO: 425149 - DNA, 706 bp, Homo sapiens
  misc_feature: GZ8MTXP02GUB0D.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtggggggaggcgtcggccccgaggtacgggggtccctgagactctcctgtgcagcctctggattcaccttcgataatggaatatgcaggtcggtcccgccgaggctccgaggcggaggggctgggaggtggggtggcgtaggggttgtcggttctacgttttcgagttgggaaaggtaaaacttcgaaaggttcgttaacgggttgtacgtttcccggttggacgggggtcctattacccgacctaacttccctaccgaaggaacgtaaccgtaaacgttccgaaacgaaaccaccgtaagttacgttaccttacttaaccaaaagttacgaaacgacgtaccccgtagaaccgtaaccgtacgaaccgggaaccgaccgggtaccgtttagtttacgtttttggacggttacgacgttacgttacttacgtttaacgtttaacctaaaacgtttcggttactacgttacccggacggtcccggtaccggggg

SEQ ID NO: 425150 - DNA, 625 bp, Homo sapiens
  misc_feature: GZ8MTXP02GIZW5.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagactctcctgtgcagcctctggattcaccttcgataattggaatatgcagtggtccgcaggctccgaggcgaggggctgggagtgggtggcgaggtgtgtctatttccagtggaaggaaatcgaaggttcgtacgggtgtacgtttccggttggaggggtccctattcccgacctatcctaccgagaacgaactaaacgttaccgaagaaaccacgacgtcgtacttcttactaaactagaaacacgacctagacgacctacgaacggaccgaccgggtccgttgtttacgttttcgtgtacgtagtacttacttcttacgtttacctaaaacgttcggttactacgttaccggaccgtccggtacggggtacccgg

SEQ ID NO: 425151 - DNA, 602 bp, Homo sapiens
  misc_feature: GZ8MTXP02G1A8A.44.27.C05.1.454.CMB.2.raw
  modified_base (301)..(301): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtggtccncaggctccaggcgagggctggagtgggtggcaggtgtgtctatttccgagtggaagaaatcgaagtcgtacgggtgtagttccggttgaacggggtccctaagtttccacctatacctaccaagacgaactaacttaccgaagaacacgagtcgtactcttacaaatagaacacgtaccagacgacctacgacgaccgacggccgttagttagttttcgtgtacgtagtacttacttacgttacgtttaaccgtaaaacgttcggttactacgttacgaccgtccgttacggggtacccgg

SEQ ID NO: 425152 - DNA, 781 bp, Homo sapiens
  misc_feature: GZ8MTXP02G1UXK.44.27.C05.1.454.CMB.2.raw
  modified_base (289)..(289): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcacctcgataatggaatangcaggtcggtccgccaggcctccgaggcggaggggcgtgggaggtggggtggcgtaggtgtgtctagtttccgagtggaagtaaatcgtaagtcgtaggtgtacgtttccggttagacggggtccgtactttaccaacccgtacttacccgtaccgaacggtaacggtaaacctaaacgtttaccccggaaagtaaaacccgaaccggtaacgttacggtttacccttaaccgtttaaacctaaaagttaccggaaacctaaccgggtacccttaacggtaacccgaaccccgttaacggaaaccgggtacccggtaaaccgggttacccggtttcggttttaaacgtttttcgggtacggtaaccggttaacgttaacccgtttaaacgttccgtttaaccggttttaaacccttaaaacggtttccgggtttaacccttacggttacccggtaacccggtacccgggtttaccgggggtaaacccccggg

SEQ ID NO: 425153 - DNA, 686 bp, Homo sapiens
  misc_feature: GZ8MTXP02GDDL1.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtatcaggtgcaattcgtggagtcgtgggggagcgtggccccaggtagggggtccctgagactctcctgtgcagcctctggattcaccttcgataatggaatatgcagtggtccgcaggctcgaggcgagggctggagtgggtgcgaggtgtgtctatttccgagtgggaagaaactcgaaagttcgtacggggtgtaacgtttcccggttaggacggggtccgtattcccaccctattcctacccgaagaacgaacctaaacgttacccggaagtaaaccgaacgtaacgttacgttaccttacgttaaccgtaaaattacgtaaaccgaacgtacccgtacggaacgtaacccttacgaacggaccgtaaccgggtccgttaggtttaacgtttttggtacggtacggtaacgtacgttaacgttaccgttacgttttaaccgtaaaacgtttcggttaccttacgttaccggtaccgtacccggttacggggtacccgg

SEQ ID NO: 425154 - DNA, 752 bp, Homo sapiens
  misc_feature: GZ8MTXP02GWUOU.44.27.C05.1.454.CMB.2.raw
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtgggtccgccaggctccgaggcggaggggctggaggtggggtggcgaggtgtgtctatttcagtggaagaaatcaagtctacggtgtattccggtgacgggccgattccaacctatcctaccgagaacgaacaacttaccgaagaaacacgtagttcgtcttacttaacaaaatcgaaacagacctagaacaccctacgacgggaccgacgggtcccgttagtttaacgtttttggacgtacggtaagtacttacttacgttacgtttaaccctaaaagtttccggttactaacgttccggtaccgtcccggttacgggggacccgtaaccgggggtaacccgttccggtacccgtaccccggttcccgtcccgtacccgggtacccctaccccgaacccggaaccgggcccccgtaacggttccccggttcccccgtttcccccggtcgggtccccgtccccgttaccggcccgtacccggaacggtaccgaccccgtaacccgtcccggaacgaccggaccaccggaccggcccggtccccggg

SEQ ID NO: 425155 - DNA, 601 bp, Homo sapiens
  misc_feature: GZ8MTXP02F2NKL.44.27.C05.1.454.CMB.2.raw
  modified_base (263)..(263): a, c, t, g, unknown or other
  modified_base (301)..(301): a, c, t, g, unknown or other
  modified_base (377)..(377): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcaccttcgataattggaatatgcagtggtccncaggctccgaggcgaggggctgggagtggggtgcgagggtgtgtcatttccagtggaagaatcgaagtctagggtnattccgtagacggggcctattccgaccatcctacagagactaatcccgaagaacacagtcgtactacttacaaatgaaacacgcctagacgtaccacgaaggaccgacggtccgttagttacgtttttggaggtccgtaaggtaaccttacttacgttacgtttaaaccgaaaagtttccggttactaacgtttccggaaccgtccggtacggggtaaccccgg

SEQ ID NO: 425156 - DNA, 626 bp, Homo sapiens
  misc_feature: GZ8MTXP02JNMQD.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctccgaggcgaggggctggagtgggtggcgagggtgtgtcgtatttccgagtggaaggaaatcgaaagtctacgggtgaactttccggttgaacggggtcccgtatttcccaaccctattccgtacccgaaggaacggaactaaacgttccgaagaaaccaccaggtctacttactttacaaatagaaacacggaccctagacgaccctacgaacggacacgggtcccgttggttacttttcggcgtcgaagtaccgttatacgttacgtttaccaaaagttccggttactacttccggacgtcccggttcggggacccg

SEQ ID NO: 425157 - DNA, 667 bp, Homo sapiens
  misc_feature: GZ8MTXP02JMDXO.44.27.C05.1.454.CMB.2.raw
  modified_base (203)..(203): a, c, t, g, unknown or other
  modified_base (284)..(284): a, c, t, g, unknown or other
  modified_base (287)..(287): a, c, t, g, unknown or other
  modified_base (295)..(295): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgnggagtcgtgggggagcgtggccccaggtagggggtccctgagactctcctgtgcagcctctggattcacttgatatgaatngcngtggtccncaggctccaggcggaggggctgggagtgggtggcgaggtgtgtcatttcgagtagggagtaaatcgaagtcgtacgggtgtacgtttccggtaggacgggaccgtatttacccgaccctactcctacccgaagacgaaaccgtaacgttacccggaaacggtaaactaacgacgttacgttaccttacgtttaacaaaacgttacgaaaccgtacggacctacgacgaaccctacgaacggaccgaccgggtccgttacggtttaacgtttttcgggtggtaacggtacggtaaccttacttaccgttacgtttaaaccgtaaaacgttccggttacttacgttaccgtaccggtccggtacgggtacccgg

SEQ ID NO: 425158 - DNA, 720 bp, Homo sapiens
  misc_feature: GZ8MTXP02IMU0T.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccagtagggggtccctgagactctctgtgcagcctctggattcaccttgataattggaatatgcaggtcggtccgcgaggctccgaggcggaggggctgggaggtggggtggcgaggtgtgtctatttccagtggaagtaatcaaggttctacggggtgtacgtttcccgggttagaccgggggtccgtaactttcccgaccctatcccgttaccgaaggacgaaacctaaacgtttacccggaaagaaaccgtaacgagtacgttaccttacttaacaaaacgtacgaaactacggtaccctacggaccgtaaccgtacgaacgggtaaccgtacccgggtaccggttacggttttaacgttttttcggacggttaccggtaaacgtaccgttacttaccgtttacggtttaaaaccctaaaacgtttcccgggtttaaccttaccgtttaaccggtacccggttaccccgggttaacgggggtaacccccggg

SEQ ID NO: 425159 - DNA, 595 bp, Homo sapiens
  misc_feature: GZ8MTXP02HDCU8.44.27.C05.1.454.CMB.2.raw
  modified_base (529)..(529): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctcgtggacttcaccttcgataattggaatatgcaggtggtccgcaggctccgaggcgaggggctgggagtggggtgcgaggtgtgtctatttccgatgggaaggtaaatcaaagtctacgggtgtagttccggttgacggggtccgtatttccgaccactctaccagacgactaagttcccgaagaacctacagtcgtactacttacaaatcgaactacgacctagacgacctacgaacggacgacggtccgtagtttattttcgngtcgagtactacgtccttagtttacaaaagttcgttactacgttcgacgtccgtacggggtacccg

SEQ ID NO: 425160 - DNA, 655 bp, Homo sapiens
  misc_feature: GZ8MTXP02JQCF3.44.27.C05.1.454.CMB.2.raw
  modified_base (286)..(286): a, c, t, g, unknown or other
  modified_base (356)..(356): a, c, t, g, unknown or other
tcagacagtatatacacgaccggtgctcgatttagacgcgatcgaagggtttgggggaagagggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccagtagggggtccctgagactctcctgtgcagcctctggattcaccttcgataattggaatatgcaggtgggtccnccaggctccgaggcgagggctggagtgggtgcaggtgtgtcatttcgatggagaaatcaagtctacggtnatccgtgaggccattccgacctatcctaccagacgacaacttaccgaagtaaacacgtagtcgtactacttacaaatacgaaacacgacctagacgtaccctacgaacggacctacgggtaccgttagttaacgttttggtggtaccgtaaggtaacgttattaccgtttacgtttaacccgtaaaacgtttccgggtttactacgtttaccggaaccggtcccggttacgggggaacccggtaaccggggtaaccccgttcgggtacccgtacccggttcccgtaccccgttccccgg

SEQ ID NO: 425161 - DNA, 534 bp, Homo sapiens
  misc_feature: GZ8MTXP02IRDCW.44.27.C05.1.454.CMB.2.raw
  modified_base (189)..(189): a, c, t, g, unknown or other
  modified_base (234)..(234): a, c, t, g, unknown or other
  modified_base (280)..(280): a, c, t, g, unknown or other
  modified_base (299)..(299): a, c, t, g, unknown or other
  modified_base (337)..(337): a, c, t, g, unknown or other
  modified_base (363)..(363): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcgtaatnttcttagtcttaattgtctctgtatcaacatcatccaaggtaaacnccccaaactcatcatctangagctatagacgtcctgaggttctaatcgcttcacctncctacacgtccgacaacgcgcctccngacatctacgtggctcgagcgtagaggacgagctagtattattattgttacgctcgagttatgttacgcgtcagtactacttagtcgtacgttacggaagtcggactaaggtccaccgttacacgtacaccgacccgaaacgacccaaaccctctagcctactcgttcccg

SEQ ID NO: 425162 - DNA, 703 bp, Homo sapiens
  misc_feature: GZ8MTXP02JZ9HV.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctctggattcaccttgataatggaatatgcaggtggtccgccaggcctccgaggcggaggggctgggaggtggggtggcagggtgtgtctatttccagtggggaaggtaaaatcgaaagttcgtacgggtgtaagtttccggttgggacgggcccgtattcccgaaccctactcctacccgaagtaacgaactaaacgttacccgaaacgaaaaccgaaccgtagttcgtaccttacctttaaacaaaagttacgaaaacacggtacccgtaaggtaaccgtaaccctaccggaacggaacccgtaaccgggtcccgttaggttttacgtttttacggtacggtaccggtaaacgtaccgttacttacgtttacgtttaaacctaaaacgtttccggttactaacgtttccggaccggtcccgggttacgggggaacccgg

SEQ ID NO: 425163 - DNA, 633 bp, Homo sapiens
  misc_feature: GZ8MTXP02H5I6T.44.27.C05.1.454.CMB.2.raw
  modified_base (188)..(188): a, c, t, g, unknown or other
  modified_base (221)..(221): a, c, t, g, unknown or other
  modified_base (269)..(269): a, c, t, g, unknown or other
  modified_base (286)..(286): a, c, t, g, unknown or other
  modified_base (332)..(332): a, c, t, g, unknown or other
  modified_base (606)..(606): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatctcctgcactgganccagcggtaatattcttagttctttaactttgtcttcctggtatcaanatcatccaaggtaaacncccccaaatcatcatctatgagcctataagacgcctgagggtttanaaatcgcttcacctcgcctacgacgtccgacaaccgccgaccctcacgaactaacttccgtacgtcgggaccctaccgaggtctagggaacggcgtaggtctagttaatttaatttgttgttcgtactagtaagttcgttcggttcgaccgtataacttacgttaagtttacgttcggttacgtttaacggggaacggtttacgggaaaacccgttagggtacccctacggttaccgtacgtaccgacgaaccccgaacgacccctaaaacccncgttctaccctacttccgttacccccg

SEQ ID NO: 425164 - DNA, 615 bp, Homo sapiens
  misc_feature: GZ8MTXP02GBZLA.44.27.C05.1.454.CMB.2.raw
  modified_base (538)..(538): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggaggcgtgggcccccaggtagggggtccctggacgactctcctgtgcagcctgtgcttcaccttgataattggaatatgcaggtggtcccgcaggctccgagggccggaggggcgtggaggtggggtggcgaggtgtgtcagtttcagtggaaggtaaatcgaaagtcgtaacgggtgtacttccggttgagggccctattccgacctaactctaccgagacgacaacgttaccgaagaacactagtagtcttacttacgtaaatacgaacacgcctagaacgacctacgaggaccacggtccgtaggttattttcggngacggtacgtacgttacgtcttacgtttaacctaaaacgttaccggttactacgttaccgtacggtccggtacgggg

SEQ ID NO: 425165 - DNA, 634 bp, Homo sapiens
  misc_feature: GZ8MTXP02H6RNF.44.27.C05.1.454.CMB.2.raw
  modified_base (300)..(300): a, c, t, g, unknown or other
  modified_base (367)..(367): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggaggcgtcggccccgaggtacgggggtcctgagactctctgtgcagcctctggacttcaccttcgattaagttggaatatcgnaggtggtcccgcgacggcctccgagggccggaggggcgtgggaggtggggtggcgtagggtgtcgtntagttcgagtggaagaaatcgaagttcgtcggtgtacgttccggttaggacggtccgtattccacccgatcctaccgagacgaactaacgtaccgaaagaacacgagtgtcttacttacaaattgaaaccagtacccgtagaccgacgtacgaacggaccgtaacggtccgtagttttcgtttaggtcgacgtacgtacttacgtcgtttacgttaacctaaaagtccgttaactaccgttcggaaccgtccggttacgggacccgg

SEQ ID NO: 425166 - DNA, 792 bp, Homo sapiens
  misc_feature: GZ8MTXP02IQQY7.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcaggtgggtccgcaggctccgaggcggaggggctgggagtggggtggcagggtgtgtcagtttccagtggaagaaaatcgaaagttctacgggtgtaacgtttcccggttaggacggggtcccgtaatttcccgaacccgtaacttcccgttacccgaaacggtaacggtaaacccgtaaaacgtttaccccggaaaacggaaaaccctaaaccgtaacggttacggtttacccttaaccgtttaaaccctaaaaagtttaacgaaaacccgtaaccgggtaccccgttaacggaaaccggtaaccccgttaccggaaacggggaaccccggtaacccggggtaccccggtttaaggtttaccggttttttagggtacggtaccggtaaacggttaaccgttaacgtttaccgtttacggttttaaaccctaaaaacgtttccggtttaacctaacgtttacccggtacccggtacccggtacgggggtaacccccggg

SEQ ID NO: 425167 - DNA, 556 bp, Homo sapiens
  misc_feature: GZ8MTXP02HG512.44.27.C05.1.454.CMB.2.raw
  modified_base (271)..(271): a, c, t, g, unknown or other
  modified_base (350)..(350): a, c, t, g, unknown or other
  modified_base (415)..(415): a, c, t, g, unknown or other
  modified_base (460)..(460): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcaccctcctcactcaggacacagggtcctgggcccagtctgccctgactcagccctccctccgcgtccgggtctgtcggtcagtcagtcaccatcctcctgcactggaaccagctaattttcattggtaaatcatgactatgtctcctggtaccngcatcacccaggcacacgcccccagactcgtgtattttgaggtcaatacgccgcccctgacggggtcccgatcggttcncctggctccgagtctcggcacgccggcctcccgtgaccgtctcgtgggcctccgaggctgacgangtagctgatttatacgtgcagtctccgagtggaacgcactatgtnttgtcgttttcggacggtacgggacagtacgtcgaccggttccgtacggcaacggcccgtaacggtcctcggtccccctcggtcctaccgttcccg

SEQ ID NO: 425168 - DNA, 607 bp, Homo sapiens
  misc_feature: GZ8MTXP02JTYGU.44.27.C05.1.454.CMB.2.raw
  modified_base (423)..(423): a, c, t, g, unknown or other
  modified_base (443)..(443): a, c, t, g, unknown or other
  modified_base (486)..(486): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcacgcctccctccgcgtccgggtctgtcggtcagtcagtcaccatctcctgcactggaaccagctaatttcattggtaatcatgactatgtctcctggtacagcatcaccagcacacgcccccagactcgtcgtattttggaagtcaataagcgtacccctcgacggggtcccgatccggttctccgtcggtcctccaagtcgtcggacaccgcggtccctcccgtgaccgtctcgtcgggcctccgaggctagacgngtgcggtctagcttatttcngtccttcctctatagtcgacaaggcgtacgttacggttttacncggttacgttacggacgttacggggtaaccctaagggtacctacccggttacctacgtacccgaacggacccgaaccggtaccccaaaccccgtactacgtaccctaccgtcctttcccgg

SEQ ID NO: 425169 - DNA, 710 bp, Homo sapiens
  misc_feature: GZ8MTXP02H292S.44.27.C05.1.454.CMB.2.raw
  modified_base (311)..(311): a, c, t, g, unknown or other
tcagacagtatatacacgaccggtgctcgatttagacgcgatcgaagggtttggggcctgggagacgagccccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggagcgtggccccgaggtagggggtccctgagactctcctgtgcagcctcgtggattcaccttcgataaattggaatagtgctaggtcgggtccnccgaggcctcgaggcgaggggctgggaggtgggtggcgaggtgtgtctattccagtaggaagtaaactcgaagtacgtgggtagtacgttccggtaggacggaccgtattaccgacccattccgaccgaagtaaccgaacttaaacgttacccggaaagtaaccaaacgtacggttacgtaccctttactttaaacccgaaaagtttaccgtaaaccgaacggttacccgtaaacggaacgtaacccgttacggaaacggtaacccgtacgggtccgtttaggtttaagtttttcggacgtacgtaacgttaacttacgttaccgtttaacgttaacccgtaaaagttcccggttaactacggtttacccgaaccgggttccggttaccgggaacccgg

SEQ ID NO: 425170 - DNA, 521 bp, Homo sapiens
  misc_feature: GZ8MTXP02ILSZQ.44.27.C05.1.454.CMB.2.raw
  modified_base (188)..(188): a, c, t, g, unknown or other
  modified_base (234)..(234): a, c, t, g, unknown or other
  modified_base (266)..(266): a, c, t, g, unknown or other
  modified_base (280)..(280): a, c, t, g, unknown or other
  modified_base (363)..(363): a, c, t, g, unknown or other
  modified_base (382)..(382): a, c, t, g, unknown or other
  modified_base (418)..(418): a, c, t, g, unknown or other
  modified_base (425)..(425): a, c, t, g, unknown or other
  modified_base (436)..(436): a, c, t, g, unknown or other
  modified_base (512)..(512): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaatnttcttagtcttaatttgtctctggtatcaacntcatccagtaaacnccccaaatcatcatctatgaggcctataagacgtccctgtagggttctaagtcgtacttcactcgcctcaaagtccgacaacncggcctccctgaaccatcncgtgggcctcgagtctgagacgaggctagattaatntgtgctnagtatggttcncgctatctacttatgttcgtaggaggttcggacaaggtctacggtgcgtaaggtcacgaaccgacggccaaccctnctacactcg

SEQ ID NO: 425171 - DNA, 817 bp, Homo sapiens
  misc_feature: GZ8MTXP02F0KGM.44.27.C05.1.454.CMB.2.raw
tcagacagtatatacacgaccggtgctcgatttagacgcgatcgaagggtttggggagtcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacggggggtccctggagactctcctgtcgcacgcctctggattcaccttcgaattaagttggaaattatgcgtaggtcggggtcccgccagggcctccgagggcggaggggctgggaggtggggtggcgaggtgtgtctatttcgagtgggaaggtaaactcgaaaggttccgtaacgggtagtacgtttcccggtagggtacggggtccgtacgttaccaccctacttaccgtacccgaaggtaacgtaaactaacgttacccggaaacgaaccgtaaacgtacggttacgttaccctttacctttaaacgtaaaacgttaacggaaaaccgtacggtaacccgttacggaaaccgtaacccgttaccggaaaccggggtaacccgtaacccgggggttaccccggttttaagggttttaacgtttttttacggggtacggtaccgggttaacgttaaacccgtttaacgtttcccgtttaaaccggtttttaaaccccgttaaaaaacggttttcccgggttttaacgttaccggtttaccggtaaccccgggttacccgggtttaaaccccgggggg

SEQ ID NO: 425172 - DNA, 545 bp, Homo sapiens
  misc_feature: GZ8MTXP02GSMUH.44.27.C05.1.454.CMB.2.raw
  modified_base (234)..(234): a, c, t, g, unknown or other
  modified_base (364)..(364): a, c, t, g, unknown or other
  modified_base (381)..(381): a, c, t, g, unknown or other
  modified_base (419)..(419): a, c, t, g, unknown or other
  modified_base (422)..(422): a, c, t, g, unknown or other
  modified_base (435)..(435): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatnttcttagtcttacttgtctctgtatcaacatcatccaagtaaacgaccccaaactcatcatctatgagctataagacggccctagtaggggtttctaagtcgtcttcacctgcctccaagtccgacaacncgtcctcctgacactcnctcggctcgagctgagacgagctgtattattatgttanctnagtatgttcgtcnctatctacttatgttcgttacggaagttcggacaaaggttcctaaccgtccgttacggtccgacgacccgaacggaccccaaccctacgtacgctaccttccgttccccg

SEQ ID NO: 425173 - DNA, 542 bp, Homo sapiens
  misc_feature: GZ8MTXP02ISQAT.44.27.C05.1.454.CMB.2.raw
  modified_base (266)..(266): a, c, t, g, unknown or other
  modified_base (298)..(298): a, c, t, g, unknown or other
  modified_base (330)..(330): a, c, t, g, unknown or other
  modified_base (354)..(354): a, c, t, g, unknown or other
  modified_base (365)..(365): a, c, t, g, unknown or other
  modified_base (388)..(388): a, c, t, g, unknown or other
  modified_base (433)..(433): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctctggtatcaacntcatccagtaacgcccccaaatcatcatctangagcctataagagccctgagggtttcaatcgnttcactgcctcacgtccgacaacnccggcctcccngaccatctctgggcctccaggcngaggacgagctgtaattattatgttgcttcagtattgttcggtcnctattcactttatcgttacttcgggaaagttcggggaccaaaggttccaccgttccgtacgtccaacgtacccaaacggccccaaaccctactgtcccacgtctttccg

SEQ ID NO: 425174 - DNA, 665 bp, Homo sapiens
  misc_feature: GZ8MTXP02JBZ2L.44.27.C05.1.454.CMB.2.raw
  modified_base (269)..(269): a, c, t, g, unknown or other
  modified_base (293)..(293): a, c, t, g, unknown or other
  modified_base (305)..(305): a, c, t, g, unknown or other
  modified_base (333)..(333): a, c, t, g, unknown or other
  modified_base (342)..(342): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccaggtacgggggtccctgagactctcctgtgcagcctntggattcaccttgataatggaatntgcagtggtccncaggctcgaggcgagggctggagtgggngcgaggtgngtctatttcagttgaaggtaaatcgaaagttcgtacgggtgtaacgttttcccggtagggaacggggtcccgtagtttaccacccgtaacgttcccttacccgaggaacgtaactaacgttacccgaaggtaaaccacgtacgttacgtaccttacttaacaaaagttacgaaacacgtaccgtacgaacgacctacgacggaaccgacggtacccgttagtttacgttttgtacggtacgtaacggtacgttacttcgttacgtttaaccgtaaaacgttccggttactaacgtttccggaaccgtccggttaacccggggg

SEQ ID NO: 425175 - DNA, 745 bp, Homo sapiens
  misc_feature: GZ8MTXP02GU513.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggccgcaggctccgaggcggaggggctggaggtggggtggcgagggtgtgtctatttccagtggaagaaattcgaaaggttctacggggtgtaacgtttcccgggttagggacgggggtcccgtagtttacccgaacccgtaacgttacccttacccgaacggaaacggtaaacccgtaaaacgtttacccggaaacgtaaaacccgaaccgtaacgttcggttaccttaccgtttaacaaaacgttagaaaaccgtacggtacccttaacggaacgtaaccctacgaaacgggaccgtaaccgggtcccgttacggtttaaacgtttttcgggttacggtaccggtacggtaaaccttacgttaccgtttaacgttttaacccgtaaaaacgtttccgggtttacttacgttaccggtaaccggtacccggttacgggggtaaccccggg

SEQ ID NO: 425176 - DNA, 654 bp, Homo sapiens
  misc_feature: GZ8MTXP02JET9W.44.27.C05.1.454.CMB.2.raw
  modified_base (288)..(288): a, c, t, g, unknown or other
  modified_base (300)..(300): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctctggatcactgatatgaatntgcagtggtccncaggcctccgaggcggaggggctgggaggtggggtggcgtagggtgtggtctagtttcgagtaggaagtaatcgaagtcgtacgggtgtacgtttccggtggacgggtcctagttaccgacctactcctaccgagaacgaactaacttaccgaagaacacgagttacgtcttacttaactaaagtacgaaacacgaccgtagaccgtacccgtacgaacgggaccgaccgggtaccgtttaggtttaacgtttttggacgtacggtaacgtaccttaacgttaccgtttacgtttaaccgtaaaacgtttccggttactacgtttaccggtaccggtacccggttaaccggggg

SEQ ID NO: 425177 - DNA, 590 bp, Homo sapiens
  misc_feature: GZ8MTXP02GQK0T.44.27.C05.1.454.CMB.2.raw
  modified_base (171)..(171): a, c, t, g, unknown or other
  modified_base (305)..(305): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggagcgtggccccgaggtaggggggtccctgagactctcctgtgcagcctcgtggattcaccttcgataattggaatatgcaggtggtccncaggctccgaggcggaggggctgggagtggggtgcgtaggtgtgtctatttcgaagtgggaagaaatcgaaagtctacgggtgaatttccggtagacggggcctattccgacctactcctaccagacgaactaactaccgaagaacacagtcgtactactacaaatgaacacgctagacgacctacgacgaccgacggtccgttagttacgtttgagtacgagtacttactacgttacgttaccaaaacgttcgtactacgtcgacgtccgtacgggtaacccgg

SEQ ID NO: 425178 - DNA, 652 bp, Homo sapiens
  misc_feature: GZ8MTXP02G8USO.44.27.C05.1.454.CMB.2.raw
  modified_base (330)..(330): a, c, t, g, unknown or other
  modified_base (349)..(349): a, c, t, g, unknown or other
  modified_base (365)..(365): a, c, t, g, unknown or other
  modified_base (396)..(396): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctggagtgggtggcaggtgtgtcatttcatggaaggaaatcaagtctacggtgattccgtgaggccatcacatctcagagacaatcgagaacacagtntctctacaaaatcgaaacngcctagacgaccctanagggaccacgggccgttagttactttttggngtacgtaagtacttaatcttacgtttacctaaaattcggttactacgttacgaccgtccgtcggggacccgaacgggtaaaccccgtcggttaccgacccgttcctcccgtcccggccctacccgaaccgtaacggggcccctaacgttcccggttcccttccccccgtccggtcccgtccccgtcggacccgtcccgaacggccgacccgtaacccgtcccggaacgacggacccaccgaccggcccggccccgg

SEQ ID NO: 425179 - DNA, 676 bp, Homo sapiens
  misc_feature: GZ8MTXP02GKK45.44.27.C05.1.454.CMB.2.raw
  modified_base (306)..(306): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtcggccccaggtacgggggtccctgagactctcgtgtgcagcctctggacttcacttcgataattggaatatgcaggtcgggtccncgaggcctccgaggcggagggctgggaggtggggtgcgtagggtgtgtctatttccgagtggaagaaatcgaaagttcgtacgggtgtacgtttccggttaggacgggtacctattacccgaacctataccctacgaacgtaacgaacctaacgttaccgaagtaaacaacgtagttcgttacttaccttaaacgaaacgttacgaaaccgacgtaccgtacgacgtacccgttacgaaacggaccgtaaccggtccgtttagtttaacgttttggtcggtacgtaacgtaccgttacttacgtttacgtttaaacgtaaacgtttccggttaactacgttaccggaccgtccggtaccgggtaacccgg

SEQ ID NO: 425180 - DNA, 606 bp, Homo sapiens
  misc_feature: GZ8MTXP02J0Z2H.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggtttcctcgttgccctcttaagaggtgtcatgtgtcaggtgcaattcgtggagtctgggggaggcgtggccccgaggtaggggggtccctgagactctcctgtgcagcctctggattcaccttcgataattggaatatgcagtgggtccgccaggctccgagggcgagggggctggagtggggtggcgagggtgtgtcagtttcagtggagtaaatcaaggtctacggtggattccgttgagggtccgtatcaaccatcctaccagtagacataccgaagacacagtgtctcttataactaggaacctaagcctaggacgacctacgaaggacgtaccgggacccgttcggttaattttggtacgtcggtaacgtacgtaacttcctttacggtttaaccctaaaacgttcggtttacctacgtttaccgtaaccggtccgtaccggggg

SEQ ID NO: 425181 - DNA, 591 bp, Homo sapiens
  misc_feature: GZ8MTXP02FNM8A.44.27.C05.1.454.CMB.2.raw
  modified_base (190)..(190): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcggtcaccatctcctgcactggagccagcgttaatattcttagtcttaactttgtctcctggtatcaacatcatccagtaaacgccccaaactcatcatctatgaggcctaataagacggccctcgtaggggtttctaaactcgtcttcacctcgcctcgaacgtcccggacaacgccggccctccctagaccaatctcgtgggcctccgaggtctggaggacggagctagtaatttaattattgttgctacgagattgttcgtcgctatctattatgtacgttcggaaggttacggacgtaacggtaccgtaccgtacgttacggtaccgacgtaaccccgaaacgggcccctaaaccccgtacgtacgtacctacctaccgtttccccg

SEQ ID NO: 425182 - DNA, 594 bp, Homo sapiens
  misc_feature: GZ8MTXP02GWIJG.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctctggattcacttcgatatggatatgcagtggccgcaggctccgaggcgaggggctgggagtggggtgctaggtgtgtctgtttccagtggagaatcgaagtctcgggtgactttccggttgacgggtccattccaccatctccgagacacgaattccgaagaacacgagtcgtactcttacaaatagaacacgacctagacgtaccgacgaaggaccgtacgggcccgttagtttacgttttaggacgtcgaggttactacgttacttacggtttaaccaaaagttccggttacgtacgtttaccggaccgtccgggtacggggaaccccgg

SEQ ID NO: 425183 - DNA, 611 bp, Homo sapiens
  misc_feature: GZ8MTXP02HSO9Q.44.27.C05.1.454.CMB.2.raw
  modified_base (301)..(301): a, c, t, g, unknown or other
  modified_base (380)..(380): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataatggaatatgcagtggtccncaggctccgaggcggagggctgggagtgggtggcgaggtgtgtctatttccgagtaggagaaatcaagttctacgggtnattccgtgacgggccagtttccacctatcctacgagacaactaacttccgaagaacacgtagtcgtactcttacaaattagaaacacggacctacgaacgaccctacgaacggaccgacggtcccgttagtttagtttttcggtgtaccgtaagtacgttaacttcgttaacgtttaccctaaaaggttcgttacttacgttaccggaccgtccggtacgggtaaccccgg

SEQ ID NO: 425184 - DNA, 745 bp, Homo sapiens
  misc_feature: GZ8MTXP02I87Q4.44.27.C05.1.454.CMB.2.raw
  modified_base (293)..(293): a, c, t, g, unknown or other
  modified_base (304)..(304): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgacgactctcctgtgcagcctctggattcaccttcgataatggaatangcagtggtccncaggctccgaggccgaggggctgggacgtggggtggcgtagggtgtgtctatttccgagttaggaaggaaaatcgaaagttccgtagggtgtacgttccggttgacggggtcctattcaaccctattaccctacccgaagaacgaacctaaacgttaccgaaacgtaaaccgaccgtagttacgttaccttaccttaaactaaaacgttacgaaacccgtaacgtaccccgtaacgaaccgtaaccccgttaaccggaaacgggaacccgtaacccggggttacccggtttaacgtttttaacggtttttcgggtaccggtaccggtaaacgttaaaccgttttaccttaccgttttaaccgtttaaaccccgttaaaaagtttcccgggtttaactacggtttaccggtaccggtcccggttaccgggggtaaaccccgg

SEQ ID NO: 425185 - DNA, 732 bp, Homo sapiens
  misc_feature: GZ8MTXP02JLSU5.44.27.C05.1.454.CMB.2.raw
  modified_base (336)..(336): a, c, t, g, unknown or other
  modified_base (340)..(340): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcaggtcggtccgccaggcctccgaggcgaggggctgggagtggggngcgnggtgtgtctgtttccagtggagaaatcgaagttcgtacggtgtacgttccggttagacggggtccgtattccgaccctacttacccgtaccgaacggaacgtaacccgtaaacttacccggaaacgaaacccgtaacgtacggttacgttaccttacctttaaacgtaaacttacgaaaccgtacggacccttacggaacgtacccgtacgaacgggtaccgaccggggtacccgtttaggtttacgttttttacgggtacggtaaccggtaacgttaccgtttaacgtttacccgtttaacgttttaacccgttaaaaacggtttcccggttttaaccgtaaccgtttacccgggtaaccggttcccggttaccgggggttaacccccggg

SEQ ID NO: 425186 - DNA, 690 bp, Homo sapiens
  misc_feature: GZ8MTXP02I0FTF.44.27.C05.1.454.CMB.2.raw
  modified_base (293)..(293): a, c, t, g, unknown or other
  modified_base (306)..(306): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacggggggtccctgagactctcctgtgcagcctctggacttcacttgataatggaatangcaggtcggtccncgaggcctccgaggcggaggggctgggagtggggtgcgtaggtgtgtctatttccgagtagggaacgtaaatcgtaaacggttcgtacggggtcgtacgtttcccgggttgggacggggtcccgtattccaacccgtatccctaccgagtaacgaactaacgttacccgaaagtaaccgaacgtaggttcttaccttactttaaaccaaaagttacgaaacctacggtaccctagaaccgtaccctacgaacggtaccgaacgggtccgttagtttacgttttggacggtacgtaacgttacttacgttaccgtttacgtttaaacccgtaaagtttccggttaactacgtttacccggaccggtcggtaccggggtaacccgg

SEQ ID NO: 425187 - DNA, 649 bp, Homo sapiens
  misc_feature: GZ8MTXP02H8GDE.44.27.C05.1.454.CMB.2.raw
  modified_base (288)..(288): a, c, t, g, unknown or other
  modified_base (299)..(299): a, c, t, g, unknown or other
  modified_base (379)..(379): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcattcgtggagtcgtgggggagcgtcggccccgaggtacgggggtccctgagcctctcctgtgcagcctgtggattcacttcgataatgaatngcagtcggccncaggctcgaggcgaggggctgggagtggggtgcgaggtgtgtctatttcgagtggaagaactcgaagttcgtacggggtntaagtttcccgggttagacggggtcctaattcccacctactcctaccgacgaacgaacctaacgttaccgaacgaaacaaccgtagtcgttccttacttaacaaagttacgaaacacgtaccgtagaacgacctacgaacggaccgaccggtcgtttacgtttacgttttcggtacggtacgtaacgtacttacgttacctttacgtttaacctaaaacgttcggttaacgtacgttaccgtacccggtccgggttacgggaaccccggg

SEQ ID NO: 425188 - DNA, 665 bp, Homo sapiens
  misc_feature: GZ8MTXP02I40JB.44.27.C05.1.454.CMB.2.raw
  modified_base (222)..(222): a, c, t, g, unknown or other
  modified_base (282)..(282): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcgcctggacagtcggtcaccatctcctgcactgganccagcggtaatattcttagtcttaacttgtctcctggtatcaacatcatccaagtaaacncccccaaatcatcatctatgagtcctaagtaacgacggtccccttgtacggggtttctaaagtccgtcttcaccctcgccctacaacgtccggaccaacctccgggcccttacccgtagacctaactcgtcgtcggggcccttccgaggtccgtagggaacggaccgtaggccttaggtaatttatttagttgtttgctacgtagtacgttgttcggtaccactattacctatttagtcgttacgtacggggtaacggttacgggaacctaaacgggttcccaacccggttaccgttacggtacccgtaccggaacccccggaaaacggtaccccccaaaccccggtaccttacggtacccctacctttacccgtttcccccg

SEQ ID NO: 425189 - DNA, 626 bp, Homo sapiens
  misc_feature: GZ8MTXP02JH7Q2.44.27.C05.1.454.CMB.2.raw
  modified_base (546)..(546): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctggattcaccttcgattaattggaatatgcaggtggtcccgcaggctccgaggcggaggggctgggaggtggggtggcgagggtgtgtctatttccgagtgggaaggtaaatcgaaaggttctacggggtgtagtttcccggtggacggggtcctagttccaccgtacttcctacccaagagaaccaacttcccgaagaaacacagtcgtactacttacaaactagaaacacgtcctagacgacctacgacggacgacggtccgttagtttagttttcggnggtacgaggtacttactcgttacgtttaacctaaaagttccggttactacgttcggaccggtccggtcggggtaacccgg

SEQ ID NO: 425190 - DNA, 546 bp, Homo sapiens
  misc_feature: GZ8MTXP02HVG0Z.44.27.C05.1.454.CMB.2.raw
  modified_base (187)..(187): a, c, t, g, unknown or other
  modified_base (221)..(221): a, c, t, g, unknown or other
  modified_base (260)..(260): a, c, t, g, unknown or other
  modified_base (415)..(415): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctggcccagtctgccctgactcagcctgcctccgtgtctgggtcncctggacagtcggtcaccatctcctgcactgganccagcgtaatattcttagtcttaacttgtctctggtatnaacatcatccagtaaacgccccaaactcatcatctatgagcctatagagccctgaggtttcaatcgcttcacctgcctcaagtccgcaacgccgcctcctgactaatcctctcgggctccgaggctggaggacgagctagattattattgtgctnagtatgttacgcgtcatctacttagtcgttcgttacggaagtcgggaacctaaaggtcccaccgttacctacggtccaccgaccctaacggcccccaaacccgtactcgtacctaccttaccgtttccccg

SEQ ID NO: 425191 - DNA, 573 bp, Homo sapiens
  misc_feature: GZ8MTXP02F8XDB.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtggtccgcaggctccaggcgaggggctggagtgggtggcaggtgtgtcatttccatggagaaatcaagtctacgggtgattccggttgagggccgtattccaccatcctccagagacaattccgaagaacacagtgtactcttacaatgaacagacctgagacctcgaggaccacgaccgttgttacgttttgtgtacggtagtactacgttacttacgtttaaccctaaaagttccggtttactacgttccggtaacgtcccggtacggggaacccgg

SEQ ID NO: 425192 - DNA, 666 bp, Homo sapiens
  misc_feature: GZ8MTXP02H87RE.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtgagtcgtgggggaggcggtggccccgaggtacggggggtccctggacgtactctcctgtgcacgcctcgtggattccaccttcgaattaattggaattatcgcaggtgggtcccgcgaggctccgaggcggaggggctgggaggtggggtggcgtagggtgtgtctattccgagtgggagaaatcgaagttctacgggtgtaacttccggttaggacgggccgtattacccaccctactactaccgacgtacgaaacctaacgttaccgaaacgaaacaacgtacgtacgtaccttactttaacctaaagttacgaaacacggaccttacggaaacgtacccgtacgacgggaaccgtaccggtaccggttagtttacgttttcggttacggtacgtacgtactacgttacttacgttacctaaaacgttcgtactacgtacgaccgtccggtacggacccgg

SEQ ID NO: 425193 - DNA, 634 bp, Homo sapiens
  misc_feature: GZ8MTXP02JK2LP.44.27.C05.1.454.CMB.2.raw
  modified_base (203)..(203): a, c, t, g, unknown or other
  modified_base (425)..(425): a, c, t, g, unknown or other
  modified_base (506)..(506): a, c, t, g, unknown or other
  modified_base (564)..(564): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgnggagtcgtgggggagcgtggccccgaggtacgggggtccctgagactctcctgtgcagcctcgtggtacttcaccgttcgaattaagttgggaaattagtggacgtaggttcggggtccccgccgaaggcctccgagggcggagggggctgggaggtggggtggcgtaggggtcgtgtactagtttccgagtagggaagtaaatcgaaagttcgtacgggtntacgttccgtaggacgggtcctattcccgacctatctacgagtacgactacttccgaagtaacactagtcgttactcttanaatcgaacgacgacgtagacgaccgtacgacgaccgtacggtacgtgttacgtttcgngtacgtagtacttactcgttacgttactaaacgtcgttacgtacgttcgaccggtaccgtcgggtacccg

SEQ ID NO: 425194 - DNA, 615 bp, Homo sapiens
  misc_feature: GZ8MTXP02H1IY5.44.27.C05.1.454.CMB.2.raw
  modified_base (188)..(188): a, c, t, g, unknown or other
  modified_base (222)..(222): a, c, t, g, unknown or other
  modified_base (279)..(279): a, c, t, g, unknown or other
  modified_base (315)..(315): a, c, t, g, unknown or other
  modified_base (355)..(355): a, c, t, g, unknown or other
  modified_base (364)..(364): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacaggtcctgggcccagtctgccctgactcagcctgcctccgtgtctgggtcncctggacagtcggtcaccatctcctgcactgganccagcgtaatattcttagtcttaacttgtctctggtatcaacatcatccaggtaacnccccaaactcatcatctatgagctataagacgcctntagggttctaatcgcttcacctgcctcaacgtccgcaacncggcctccngacactctctgggcctcaggctaggacggacgacgggtctggtaatttagttattgttacgcttacgagttattcggtttcgtacgtcctaacgttcttaacgttagttcggttcgttacggggtaaacgttcggggaaaccctaaaggggtccaaacccgggtttcctacgggttacccaaccggtaccccgaaaacggacccccaaacccccgtacgtccggtaccttaacccgtttcccgtttcccgg

SEQ ID NO: 425195 - DNA, 626 bp, Homo sapiens
  misc_feature: GZ8MTXP02H245U.44.27.C05.1.454.CMB.2.raw
  modified_base (227)..(227): a, c, t, g, unknown or other
  modified_base (337)..(337): a, c, t, g, unknown or other
  modified_base (457)..(457): a, c, t, g, unknown or other
tcagacagtatatacacgaccggtgctcgatttagacgcgatcgaagggtttgggggggtcacaagaggcagtgctctcgggacgtcaccaccatggcctgggctctgctcctcctcaccctcctcactcaggacacagggtcctgggcccagtctgccctgactcagccctccctccgcgtccgggtctgtcggtcagtcagtcaccatctcctgcactggaaccngctaatttcattggaatcatgactatcgtctcctgtaccaacaaccaccaggacaaacgccccaaatcatgatcatgatgtacagtactccggccttggtacggggtttncggtcgcttctccgtggcctcgaagtctggaccacgaccggtcctcccgtgaccctagtccttcgccgggcctcccgaggtccgaggacggtacggacggtcctaggacttacgttacgngactagtacttataaagtaaagtaaaagagaacaaactacgttattaacgtacgtacggaacgggtagtaaacccagggtcctacgggtacccgttacgtacggtaccgaccggaacccgaacggttcccgtacccggacccccgttcggtaccttaacccgttccccg

SEQ ID NO: 425196 - DNA, 626 bp, Homo sapiens
  misc_feature: GZ8MTXP02FJVQU.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctctggattcaccttcgataattggaatatgcaggtcggtccgccgaggctccgaggcggaggggctgggaggtggggtggcgaggtgtgtctatttcagtgggaagaaatcaaagtctcgggtgtacttccggttggacgggtccgtattccaccctagtcctaccgacgacgaactaacgtaccgaagaacaacgagtcgttactcttacaaactagaacacgaccgtagacgtacctacgacggaaccgacgggtaccgttgtttaagttttcgtggtacgacggtaccttaacgttcgttacgtttaaccgtaaaagttccggttactacgttaccgacggtcccggtcggggtaaccccgg

SEQ ID NO: 425197 - DNA, 713 bp, Homo sapiens
  misc_feature: GZ8MTXP02IJ2DX.44.27.C05.1.454.CMB.2.raw
  modified_base (203)..(203): a, c, t, g, unknown or other
  modified_base (353)..(353): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgnagtggtccgccagctccaggcgagggcgtggaggtgggtggcgaggtgtgtcatttcatggaggaatcaagtctacggtgattccgttgaggccgattcaccatctccagagacaattccgagaacacagtgtctctacaaatacgaacngcctgacgaccttcaggggaccaccgggtaccgttcgtttagtttttaggtgacgtaacgtattacttacttacgtttaaccctaaaaagttcgggttactacgtttaccggaaccgtcccgttgggggacccctaaccggggtaaaccccttggggtaccctacccggttccgtcccccgttccggaccccgttccccgaaacccgtaaacgggggccccctaacgtttcccggggttccccctttccccccggttcggccccggtcccccgttacgccgttacccgaacggggtaccgacccctaacccgtacccgggaacggacgacccgaaaccgaccggggcccggtcccccggg

SEQ ID NO: 425198 - DNA, 754 bp, Homo sapiens
  misc_feature: GZ8MTXP02FTH2L.44.27.C05.1.454.CMB.2.raw
  modified_base (189)..(189): a, c, t, g, unknown or other
  modified_base (237)..(237): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggagccagcggtaaattnttcttagtctttaactttgtctcctggtatcaacatcatccaaggtaaacgcccccaaactcatcatctatgagacctataagacgccctgtaggggtttctaatcgtcttcacctcgcctacaacgtccggaccaaccgccggccctccctacgaaccaacttctacgtcgggccttaccgacggtcctaggacggtaaccgaggtccttaggtaattttaagtttaagtttcggtttacgtaccttaacgtaaggttacgtttcggttttaccgggtaccgtccctaaattcccttaaacgttttacgtttacggttaccgttttaacggggtaaaacgggttaccggggtaaaccccgtaaaacggggtttaccccctaaacccgggtttacccgtaacggggtttaacccgaaccggtaaaaccccccgtaaacccggggaaccccccctaaaaacccccgttacccgtaccggtttaccccgttaaaccctttcccgttttaccccccccgg

SEQ ID NO: 425199 - DNA, 660 bp, Homo sapiens
  misc_feature: GZ8MTXP02IFEWP.44.27.C05.1.454.CMB.2.raw
  modified_base (297)..(297): a, c, t, g, unknown or other
  modified_base (350)..(350): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtggggaggcgtggccccaggtagggggtccctgagactctcctgtgcagcctctggattcaccttcgataatggaatatgcagngggtccgccaggctccaggcgaggggctggaggtggggtggcgaggtgtggtntgtttacagtggaggaaatcaagtcgtacggtgtacgttccgtgggaggggccattacaccacgtctaccgagaacgacaacttacgaacgaaacacagtagttcctacttactaaacgtagtaaccgacgtacccgttagaacgacccgttaccgaagggaaccgacgggtaccccggtttagtttaacgttttttcgggtacggtacggtaacgtaccgttaacctttacgttaccggttttaaccgtaaaacgtttacccggtttacgtaacgtttacccggtaaccggtccccggttaaccggggg

SEQ ID NO: 425200 - DNA, 823 bp, Homo sapiens
  misc_feature: GZ8MTXP02GM150.44.27.C05.1.454.CMB.2.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaacttgtctctgtatcaacatcatccaagtaaccgaccccaaactcatcatctatgacggtacctaagtaaacgacggtaccctacggtaacggggttttactaaacgttccgtaccgtttcctaacccgtcgtaccccttaccgtaaaccggttcccgggaacccaaacccgaccccgggtcccccttaccccgtacgaaccctaaactccgttaccgtcggggtcccttacccggaacggtccgtaagggaaccgggaacggacggtaccgtaggttaaactttaagttttaacgtttcggttaagtcccgttacgtaagggttacgtttcgggtttacccggttaccgtaccttaaacgttacgttaaacttttaacgttccggtttacggtttaaccgggggtaaaagggttaacccggggtaacccgttaaaacgggttacccgttaaaccccgggttaccggttaaaccgggtacccgtaaacccggtacccccggaaaacccgggtaccccccgaaaaccccctaaccggttacccgtttacccaaccccgtttaccgttttaccccccgg

SEQ ID NO: 425201 - DNA, 655 bp, Homo sapiens
  misc_feature: GZ8MTXP02FZMZL.44.27.C05.1.454.CMB.2.raw
  modified_base (274)..(274): a, c, t, g, unknown or other
  modified_base (295)..(295): a, c, t, g, unknown or other
  modified_base (306)..(306): a, c, t, g, unknown or other
  modified_base (391)..(391): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtacgggggtccctgagactctcctgtgcagcctctggnttcaccttcgataatggaatntgcagtcggcnccaggctcgaggccggagggcgtggaggtgggtggcgtaggtgtggtctatttcgagtggaagtaaatcgaaagttcgtacggtntaacgttccggttggagggtccattccgaacctatcctaccgaagaacgaacaaacgttaccgaaagtaaaccactagttacgttcctacgttaacaaaactacgaaacgacgacccttaggaccgtaccctacgaacggaacctaacccgggtccgttaagttttacgttttggtcggtacgtaacgttaccttagttacgtttacgttaaaaccgtaaaagttccggttactacgtttaccggacgtccggtaacccggggg

SEQ ID NO: 425202 - DNA, 660 bp, Homo sapiens
  misc_feature: GZ8MTXP02FL40A.44.27.C05.1.454.CMB.2.raw
  modified_base (589)..(589): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggtttttcctcgttgccctcttaagaggtgtcatgtgtcaggtgcaattcgtggagtcgtgggggagcgtggccccaggtaggggggtccctgagactctcctgtgcagcctctggattcaccttcgataattggaatatgcaggtcgggtccgccgaggctccgaggcggaggggctgggagtgggtggcgaggtgtgtctatttccgagtgggaaggaaatcgaaagttctacggggtgtaacgtttcccggttagggacggggtcccgtaattacccaaccctaacttccctacccgaaggaacgaaacctaaacgttacccggaaacgaaacctaacgtagttacgttaccttaccttaactaaaacgtagaaactacgaccgttacgacgtaccctacgaacggaccgacggtaccgttgttactttttggngtcgagtactacgttacttcgtttaacctaaagttcggttactacgttccgtacgccggtacgggacccgg

SEQ ID NO: 425203 - DNA, 627 bp, Homo sapiens
  misc_feature: GZ8MTXP02GX96S.44.27.C05.1.454.CMB.2.raw
  modified_base (189)..(189): a, c, t, g, unknown or other
  modified_base (224)..(224): a, c, t, g, unknown or other
  modified_base (236)..(236): a, c, t, g, unknown or other
  modified_base (268)..(268): a, c, t, g, unknown or other
  modified_base (281)..(281): a, c, t, g, unknown or other
  modified_base (473)..(473): a, c, t, g, unknown or other
  modified_base (488)..(488): a, c, t, g, unknown or other
tcagacagtatatacacgaccggtgctcgatttagacgcgatcgaagggtttgggggggtcacaagaggcagcgctctcgggacgtctccaccatggcctgggctctgttgctcctcactctcctcacccaggacacagggtcctgggcccagtctgccctgactcagcctgcctccgtgtctgggtcncctggacagtcggtcaccatctcctgcactggacnccagcgtaattnttcttagtctttaacttgtctcctgtatcaanatcatcagtaacnccccaaatcatcatctatgaggcctaataacggacggtccctcggtacggggtttctaacgtcgtcttacgactccgtcctaccgaagtcccggacaaaccgtccggcccttaccctagaacctaattccgtcgtcggggccctaccgaggtccgtagacggacgaggtctagtatttagttacttgtgctnaagtgttcgttcgtntacacttacctattgtcgttacgttacggggtaagtcgggtaaacctacggtactacccggttactacgggtacaaccggacccgaaaccgaaccctaaaccccgtcgtacgtccaccgttccgttcccggttcccccg

SEQ ID NO: 425204 - DNA, 746 bp, Homo sapiens
  misc_feature: GZ8MTXP02GR3FV.44.27.C05.1.454.CMB.2.raw
  modified_base (261)..(261): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcacatggagtttgggctgagctgggttttcctcgttgccctcttaagaggtgtcatgtgtcaggtgcaattcgtggagtcgtgggggagcgtggcccgaggtacgggggtccctgagctctctgtgcagcctntggacttcgaccttcgataagttggaatactgactaggtcggtcccgccgaggcctaccggagggcggaggggctagggaggtggggtggcgtagggtgtgctagtttccagtggaaggtaaatcgaaggttcgtacggttgacgtttccggttaggacggggcctagttccaacccgtattacccgtacgaacgaagtaaacctaaacgttacccgaaagtaaacccgaacgtacgttacgttaccttaccgttaaacctaaaagttaacgaaaccgaacgtacccgtaacggtaaccgaacccgttacggaaaccgggtaccgtaaccggggtacccggtttacggttttaaacgtttttagggtcggtaaccgggtaagtaactttacgtttaccgtttaaccggtttaaaccctaaaacggtttaccggtttaacttacgttacccggtaaccggtccccgggttaccggggaaccccggg

SEQ ID NO: 425205 - DNA, 563 bp, Homo sapiens
  misc_feature: GZ8MTXP02J0P83.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatatgcagtggtccgccaggctccaggcgaggggctggagtgggtggcaggtgtgtcatttccagtggaggaatcaagtctacggtgatccccgttgagggcgattcaccatctccagagacaattccgagaacacagtcgtctcgttacaaatgaacacgctgagacctcgagacgacggccgtgttacgtttgtcgtcgagtactactcgttacgtttacccgaaaagttccggtttactacgttaccgaccgtccgtcggggtaaccccgg

SEQ ID NO: 425206 - DNA, 694 bp, Homo sapiens
  misc_feature: GZ8MTXP02GU1IT.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtgggtccgcaggctccgaggcgaggggctggagtgggtggcgaggtgtgtcatttcagtggaggaatcgaaagtctacgggtgtacgttccgttggacgggtccgtattaccaccgtaactcctaccgaagacgaactaaacgttaccgaaagtaaaccaacgtaacggttacggttacctttacctttaaccgaaaagtttacgaaaaccgacggtacccctaggtaacggaaccccgttacgaacgggaaccgtaaccgggtcccggttaggtttaacgtttttggtacggtaccgtaaaggtaccgttaacttccgtttacggtttaaccctaaaaacgtttccgggtttaccgtacgtttacccggaacccgggttcccggttacccggggg

SEQ ID NO: 425207 - DNA, 634 bp, Homo sapiens
  misc_feature: GZ8MTXP02JD456.44.27.C05.1.454.CMB.2.raw
  modified_base (307)..(307): a, c, t, g, unknown or other
  modified_base (398)..(398): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacgggggtccctgagactctccgtgtgcagcctctggattcgaccttcgataattggaatatgcagtgggtccncaggctccgaggcgaggggctgggaggttggggtcggcgtagggtgtgtctatttaccgagtgggaagtaaatcgaaagttctacggggtntacggtttccgttaggacggggtcctattccgacctatcctaccgagacgactaactccgagaacactagtgtactacttacaaattcgaaacgtacgaccgtagaacgacctacgacgacgaccgggtccgttagtttagttttcggagacgtagtaccgttattacgttacgtttaaccaaaagtttccggttaactacgtttacggaccgtaccggtacgggggtaaccccgg

SEQ ID NO: 425208 - DNA, 695 bp, Homo sapiens
  misc_feature: GZ8MTXP02FZDIT.44.27.C05.1.454.CMB.2.raw
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcaggtggtccncaggctccgaggcgaggggctgggaggtggggtggcgaggtgtgtcatttccgagtgggaagaaatcgaaagttctacgggtgtacgtttccggttagaggggtaccctagtttcccaacccgtacttccgtacccgaaaggaacgtaactaaacgtttacccgaaagaaaccgtacgtaacggttcgttaccttaccttaacgtaaaacgttacgaaactaacgacctacggtaacgaccctacgaacggaacccgaccgggtcccggttagtttaacgtttttggtacggtacggtaacggtaacttacgttaccgttacggttttaaacctaaaacgtttcgtttacgtacgttaccggtaaccggtcccggtacgggggtaaccccgg

SEQ ID NO: 425209 - DNA, 623 bp, Homo sapiens
  misc_feature: GZ8MTXP02JBLYL.44.27.C05.1.454.CMB.2.raw
  modified_base (305)..(305): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctctggattcaccttcgataattggaatatgcagtggtccnccaggctcgaggcgagggctgggagtgggtggcgaggtgtgtctatttccagtgggaagtaaatcgaaagttctacgggtgaactttccggtgaggggtcccgtattccacctatcctacccgaagacgaactaacgttcccgaagaacactagtgtactcgttaacaaattagaaaccagacctagacgacctacgacgacgtacggtccgttgttacgttttcgtagaccgtaagtacttacgttaccgttacgtttaacctaaaacgttcggttaactacgtttaccggaccgtccggttacggggtaaccccgg

SEQ ID NO: 425210 - DNA, 784 bp, Homo sapiens
  misc_feature: GZ8MTXP02FSDRU.44.27.C05.1.454.CMB.2.raw
  modified_base (170)..(170): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctnttaagaggtgtcatgtatcaggtgcaattcgtggagtcgtgggggaggcgtggccccgaggtacgggggtccctgagactctcctgtgcagcctcgtggattcaccttcgataattggaatatgacaggtcgggtccgccaggcctccgaggcgaggggctggagtgggtggcgaggtgtgctatttccagtggaggaaatcgaaaggttctacggggtgtactttcccgggttggacggggtcccgtaagtttcccgaacccgtaattccctacccgaaacggtaacggtaaaccctaaaacgtttaccccggaaagtaaaacccgaacccgtaaggttacggttaccctttacccgtttaaacctaaaacgttacggaaaacctaaccggtaccccgttaacgggaaacgtaaccccgttacgaaacggggaaccgtaacccgggggtacccggtttacgggtttaaattttttcgggtacggttaccggtaaaggttaaccctttaacgttaccgtttaaccggtttttaaaccctaaaaacgttttccggggtttaacctacgttttacccggaaccggtaccccggggttacgggggtaaacccccggg

SEQ ID NO: 425211 - DNA, 736 bp, Homo sapiens
  misc_feature: GZ8MTXP02G0U7K.44.27.C05.1.454.CMB.2.raw
  modified_base (285)..(285): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtcccctgagactctcctgtgcagcctctggattcaccttcgatattggaatatgcagtggtccnccaggctccgaggcgaggggctggagtggggtgcaggtgtgtcagtttcatggaaggaaatcgaaagttctaacgggtgtaacgtttccggttaggacggggtcccgtaatttcccgaacccgtaagttccctacccgaaggtaacgaaaccgtaaacgtttacccgaaacggtaaacccaacgtaacggttacggttaccctttaccgtttaaccaaaacgttacggtaaaaccgaacgtacccgttacggaaaccgtaaccccgtaccgaacggaccgtaaaccgggtcccggttacgtttagtttttacggttcgacggtacgtaacgttacttacgtttacgtttacccgtaaaagtttccggttactaacgtttaccgaccgtccggtcggggtaaccgtaacgggtacccgttcggtacccgtaccgttccgtaccgttccccgg

SEQ ID NO: 425212 - DNA, 503 bp, Homo sapiens
  misc_feature: GZ8MTXP02FF6N3.44.27.C05.1.454.CMB.2.raw
  modified_base (223)..(223): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactgganccagcggtaatatcttagcttaactttgtctcctggtatcaacatcatccaggtaaagcccccaaactcatcatctatgaggcctataagaggccctcaggggtttctaatcgcttcacctgcctcaagtccggcaacacgcctcctgacaatctctgggctccaggctgagacgagctgattattattgttgctcagatgttcgtcgcatcacttatgtcttcggaagtcgggaccaaaggtcaccgtctagggcatgtcgactcagaatgacagaggg

SEQ ID NO: 425213 - DNA, 712 bp, Homo sapiens
  misc_feature: GZ8MTXP02GOYL5.44.27.C05.1.454.CMB.2.raw
  modified_base (349)..(349): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcggtcggccccgaggtaggggggtccctgagactctcctgtgcagcctctggattcaccttcgattaattggaatatgacgaggtcggtcccgaccaggcctccgaggcggaggggcgtgggaggtggggnggcgtaggtgtgtctatttcagtggaagaaatcgaagttcgtacgggtgtacgtttcccggttaggacggggtccgtagttaccaacctattacccgtaccgaaggaacgaaactaaacgttaccccgaaagaaaccaaccgagttccgttactttaacctttaacgtaaaacttacggaaacctacggtaccccttaaggaaccgtaacccgtaccggaaacggacccgtaaccggggtccgtttaggtttttaacgtttttcggtaggtaccgtagttacctttagttaccgttacgttttaaaccgaaaacgtttccggttaacttacgttccggaccgtcccggttacggggaacccgg

SEQ ID NO: 425214 - DNA, 578 bp, Homo sapiens
  misc_feature: GZ8MTXP02FV9HP.44.27.C05.1.454.CMB.2.raw
  modified_base (381)..(381): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgcaggctccaggcgaggggctgggagtggggtggcagggtgtgtcatttcagtggaggaaatcaaagtctaccggtgattcgtgagggccattcacntctcagagacatacgagacacagtgtctctacaaatgaacacgcctagacgacctcgagacacggtccgtgttattttgtcgtacgagactagtcttacgtttacctaaaacgttcggttactacgttccgtaaccgtccgtacggggcccgtaacgggtaacccgtcggtaccgtacccgttcctcccgtccccgg

SEQ ID NO: 425215 - DNA, 699 bp, Homo sapiens
  misc_feature: GZ8MTXP02IKW5E.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataattggaatatgcaggtggtccgccaggctccgaggcgaggggctggaggtgggtggcaggtgtgtcgtatttccgagtggaaggtaaaatcgtaaacggttctacggggttgaacgtttcccgggttaggacggggtcctatttcccgacctatccttaccgagacgtaacgtaaagttacccggaagaaccgtaaccgagtcgttaccttacctttaaccaaaagttacgaaactacggtaccgttacggaacgaacccgttacgaacgggaccgtaccgggtacccgtttaggtttaacgttttttggtacgtacggtaacggttaaccgttactttaccgtttacggttttaaccctaaaaacgtttccggtttacttacgtttaccgtaccggttcccggtacggggtaaccccgg

SEQ ID NO: 425216 - DNA, 680 bp, Homo sapiens
  misc_feature: GZ8MTXP02JV1PN.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctctggacttcaccttcgataattggaatatgcaggtcggtccgcaggcctccgaggcggaggggctgggaggtgggtggcgaggtgtgtctagtttccgagttaggaagtaaagtcgtaagtcgttacgggtgtacgtttccggtagacggggtctagttcccaccgtactcctaccgagacgtaactaacgttacccgaagaaacctacgtaacgttcgttaaccttactttaacgaaaacgttacgaaaccgtacgggacccttaacggaacccgttaacccgtacgaacgggtacccggtaacgggttcccgttagttttacgttttggacggaccgtaaggtacttacgttacgttacgttaacctaaacggtccgttaactacgttcggacccggtccggtacggggacccg

SEQ ID NO: 425217 - DNA, 557 bp, Homo sapiens
  misc_feature: GZ8MTXP02FIKAD.44.27.C05.1.454.CMB.2.raw
  modified_base (264)..(264): a, c, t, g, unknown or other
  modified_base (382)..(382): a, c, t, g, unknown or other
  modified_base (495)..(495): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctntggattcaccttcgataattggaatatgcagtgggtccgccaggctccgaggcgaggggctgggagtggggtggcgagggtgtgtcatttccatgggagaaatcgaagtctacgggtnattccggttgagggtcattcaccatctcagagacaatccgagaacacagtgtctcttacaaatgaacacgcctagacgacctcgaggaccacggtccgttagttacttttggngtcgagacgtactactgtttaccaaaagtcggttactacgttacgacgccgtcggggacccg

SEQ ID NO: 425218 - DNA, 594 bp, Homo sapiens
  misc_feature: GZ8MTXP02JR0CQ.44.27.C05.1.454.CMB.2.raw
  modified_base (188)..(188): a, c, t, g, unknown or other
  modified_base (223)..(223): a, c, t, g, unknown or other
  modified_base (233)..(233): a, c, t, g, unknown or other
  modified_base (262)..(262): a, c, t, g, unknown or other
  modified_base (300)..(300): a, c, t, g, unknown or other
  modified_base (310)..(310): a, c, t, g, unknown or other
  modified_base (462)..(462): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacaggtcgtcaccatctcctgcactggacncagcgtaatnttcttagtcttattgctctggtatcaacntcatccagtaacgccccaaatcatcatctatgagctanagacgccctntagggttctatcgcttcacctgcctacaacgtccgactaaacgccggtccctcccgtgaaccaacttcgtcgttcgggcccttccgtaacgggctggacgggacgaggctaggtatttagttattgttgccttggaatgtcgtttcgccgtntaactcgttacgtttatgttccgtttagggaacggttacgggaaccctaaggggtaccctaaccgttccggttaaacggccaccgacccgtaaacgcccaaaaccccgtctacggtacctacgtctttcccg

SEQ ID NO: 425219 - DNA, 703 bp, Homo sapiens
  misc_feature: GZ8MTXP02FFY12.44.27.C05.1.454.CMB.2.raw
  modified_base (266)..(266): a, c, t, g, unknown or other
  modified_base (347)..(347): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntggattcaccttcgataattggaatatgcaggtggtccgccaggctccgaggcgaggggctgggagtggggtgcgaggtgngtctattccagtggaagaaatcgaaagtcgtaggtgagtttccggttggacggggtccgtaatttccgaaccctataccgttcccaaggtaacgaacctaacgttaccggaaagaaaccgactaagttcggttaccttaccttaaactaaaacgttaggaaaccaacgggacctacggaacggacccttacggaacgggaaccaaccggggtcccgttaggtttagtttttcgggcggtaccggtaaggtaaccttaacgtttccgttaacgtttttaaccccgtaaaaaggtttacccgggtttaccgtacgtttaccgggaaccggtccccggtttacgggggtaacccccggg

SEQ ID NO: 425220 - DNA, 597 bp, Homo sapiens
  misc_feature: GZ8MTXP02F710F.44.27.C05.1.454.CMB.2.raw
  modified_base (266)..(266): a, c, t, g, unknown or other
  modified_base (294)..(294): a, c, t, g, unknown or other
  modified_base (307)..(307): a, c, t, g, unknown or other
  modified_base (427)..(427): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtggccccgaggtaggggggtccctgagactctcctgtgcagcctntggattcaccttgaataaattggaatangcagtcgggtccnccaggctccgagggcgagggggctggggagtggggtggctagggttgtgtctatttccgagttgggaagtaaattcaaaggtctacggtgatttccggttgagggtccaattccacatcnccagagacaataccgagaacacagtgtctcttacgaatagaacagcctagacgacctcgaacggaccgtaacgggtccgttaggttactttttggtagtccggaggtaactaacgttcttacgtttacctaaaagttcggtactatacgtacggccgtcggggaacccgg

SEQ ID NO: 425221 - DNA, 690 bp, Homo sapiens
  misc_feature: GZ8MTXP02JOUG3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctggacgacgtctcctgtgcagcctctggattcaccttcgataattggaatatgcaggtggtccgcaggctccgaggcggaggggctgggaggtgggtggcgagggtgtgtctatttaccgagtgggaaggaatgtaacgtagttcgtacgggtagtacggtttccgtaggggaccggtactactaccgactacgtaccacgagaacgtaactacgtacgaaacgaacacgtacgtacgttacttactaaactaaagtaccgaacgtacgtaccgtagaaccgtacccgaggaaacccgggtacgtacccggttccgggtttaacttttggtttacggacggtaacgtacgttaaccttacgtttacctttaaaccgttaaaccgtaaacgggttttaccttacggttacctacccgggtacccgggttaccggtaaccccggggg

SEQ ID NO: 425222 - DNA, 679 bp, Homo sapiens
  misc_feature: GZ8MTXP02GMWD0.44.27.C05.1.454.CMB.2.raw
  modified_base (305)..(305): a, c, t, g, unknown or other
  modified_base (338)..(338): a, c, t, g, unknown or other
  modified_base (390)..(390): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctcgtgacttcaccttgataatggaatatgcagtggtccncaggctccgaggcggaggggctgggagtggggnggcgaggtgtgtcagtttcgagtaggaagtaaactcgaaagtcgtacgggtntaacgtttcccgtaggaacggggtccctagttaccaccgtactaccctaccgaagaacgaacaacgttaccgaacgaactaaccgagttacgttactacttaactaaagttacgaaacgacgtacctacggaacgtacccgtaccgaacggaaccgtaccgggtacccgttaggtttaacgtttttacggtacggtaccggtaaggttacttaacgttaccgtttacggtttaacctaaaaacgtttccggttactacgtttaccggaccggttaccggtacccggggg

SEQ ID NO: 425223 - DNA, 634 bp, Homo sapiens
  misc_feature: GZ8MTXP02HNN6P.44.27.C05.1.454.CMB.2.raw
  modified_base (318)..(318): a, c, t, g, unknown or other
  modified_base (470)..(470): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgcccctcttaagaggtgtcatgtgtcaggtgcaattcgtggagtcgtgggggaggcggtggccccagggtacgggggtccctggagctctcctgtgcagccctgtggacttccaccttcgattaattggaatagtgcgaggtcgggtccncgacggtcctccgaggcggaggggctgggaggtggggtggcgaggtgtgtctagtttcagtggaagaaatcgaagttcgtaacggtgtacgtttccggtaggacgggcctactccacacgtcctaccgaagagaactaacgttacccggaanaaccgacgtagtcgttacttctaactaagtagaactagaccctagacgacctcgaacgacgtacggtcgttacgtttagtttggtacgtgtaacgtacgttacgttacttacggtttaacctaaaagttccggttacacgtttccgaccggtccggtaccgggg

SEQ ID NO: 425224 - DNA, 692 bp, Homo sapiens
  misc_feature: GZ8MTXP02G2H8X.44.27.C05.1.454.CMB.2.raw
  modified_base (391)..(391): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcgtggagtcgtgggggaggcggtcggcccgaggtacggggggtccctggagactctcctgtgcacgcctcgtggattcaccttcgataattggaatatgcaggtggccgcaggctcgaggcgaggggctgggagtggggtgcaggtgtgtctatttcgagtggaaggaaactcgtaaagttctacggggtntaacgttccggttaggacggggtcctattccgaaccatcctccaagacggaaactaaacgttcccggaaagaaaccaacgtacgtcgtttacctacttaaactaaaagttacggaaactacggaccctagaaccggtaaccctacgaacgggtacccgaacgggttacccgttagtttaacgtttttaggtacggtaccggtaacggtaactttaacgttactttaacggtttaaccctaaaaacgtttcccggttaactacgttaccggtaccgtacccggtacgggggtaaacccccgg

SEQ ID NO: 425225 - DNA, 598 bp, Homo sapiens
  misc_feature: GZ8MTXP02I7RCQ.44.27.C05.1.454.CMB.2.raw
  modified_base (269)..(269): a, c, t, g, unknown or other
  modified_base (384)..(384): a, c, t, g, unknown or other
  modified_base (408)..(408): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagcctctcctgtgcagcctcnggtatcacttgataattgatatgcagtcggtccgcaggctccgaggcggaggggctgggaggtggggtggcgtagggtgtgtctatttcagtaggagaaatcgaagttctgggtntcgttacgtgagggtctatccacntctacagacactaactaccgagaacacagtgtactacttacaaatcgaacacgaccgtacgacgacctacgaacggacgtaccggtccgttagttagttttcgacggtcgtagtacgttacttacgttacgtttaacctaaaacgttccggttactaaccgttcgaaccgtccggtacggggtaacccgg

SEQ ID NO: 425226 - DNA, 662 bp, Homo sapiens
  misc_feature: GZ8MTXP02HVTCY.44.27.C05.1.454.CMB.2.raw
  modified_base (297)..(297): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtcctgagctctcctgtgcagcctctggattcaccttgataatgaatatgcagtggtccncaggctcaggcgagggctgggagtggggtggcgagggtgtgtctattttccgagttagggaacgtaaaatcgtaaaaggttcgtacgggtgtactttccggttcggaaggggtccaatttccaccgactcctaccgagtagaactaaagttaccgaagaaacacgtagtacgtacttacccttacaaaagttagaaactacggaccgtacgaaacgaccttacgaacggtaccgacgggtaccgtttgttaacgtttttacgggacgtacgtaacgttaacttacgttaccttacgtttaaaccgtaaaacgtttaccggttacgttacgttaccggtacccggtaccggttacggggaacccgg

SEQ ID NO: 425227 - DNA, 708 bp, Homo sapiens
  misc_feature: GZ8MTXP02I8XG3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttgataatggaatatgcagtggtcccgcgaggctccgaggcggaggggctgggaggtggggtggcgtaggtcgtgtacgtagtttccgagttagggaaagtaaacttcgaaacggttcgtacggggtgtacgtttccgggttagacggggtacctattcccgaaaccgtactaccgtaccaacggaacgaaacctaaacgttacccgaaacgaaacctaaaccgtagtacgttaccttacgttaaactaaaacgttaacgaaaccgtacgaccgttaacggactaacccgttacgaacgggtaaccaaccggttaccgttacgtttagttttacggtacgtacgtaacgtacgttacgttaccgtttaacgtttaaaccgtaaaagtttccggttaacttacgtttaccgaccgtaccggttcgggtaaacccgg

SEQ ID NO: 425228 - DNA, 586 bp, Homo sapiens
  misc_feature: GZ8MTXP02J1OZN.44.27.C05.1.454.CMB.2.raw
  modified_base (359)..(359): a, c, t, g, unknown or other
  modified_base (372)..(372): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtggtccgcaggctccgaggcgaggggctggagtgggtgcgaggtgtgctattcagtaggagtaatnaagtctacgggtntacgttcggtagacggctattccacctactctccgagacgaactactaccgaagaacacgagttcgtactacttacaaagtacgaacgacgtacctacgacgtacctacgaacggaccgacggtccgttagtttaacgtttgagtcgtacgtactacttcgttaacgttaacctaaagttcgttactacgttaccgacggtcggtacgggaccg

SEQ ID NO: 425229 - DNA, 572 bp, Homo sapiens
  misc_feature: GZ8MTXP02JP7EV.44.27.C05.1.454.CMB.2.raw
  modified_base (268)..(268): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtctctggtatcaacntcatccagtaaacgccccaaatcatcatctatgagcctaataacgacgccctgtagggtttctaactcgcttcacctcgcctaccgaacgtccggacaacgccggccctcctagacaatcctcgtcgggctccgaggcgtagaggacgaggctagtattattattgttgctacagtatgttcgtcgctatctacttagtgttacgttagggaagttcgggaacctaaggtcccaaccggtccgtacggtccaacggaccccgaaacggcccccaaacccgcttacgtaccctactccgtttccc

SEQ ID NO: 425230 - DNA, 628 bp, Homo sapiens
  misc_feature: GZ8MTXP02GOU7X.44.27.C05.1.454.CMB.2.raw
  modified_base (161)..(161): a, c, t, g, unknown or other
  modified_base (203)..(203): a, c, t, g, unknown or other
  modified_base (258)..(258): a, c, t, g, unknown or other
  modified_base (286)..(286): a, c, t, g, unknown or other
  modified_base (298)..(298): a, c, t, g, unknown or other
  modified_base (325)..(325): a, c, t, g, unknown or other
  modified_base (334)..(334): a, c, t, g, unknown or other
  modified_base (466)..(466): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttccncgttgccctcttaagaggtgtcatgtgtcaggtgcaattcgnggagtcgtgggggagcgtggccccgaggtacgggggtccctgacgctctcctgtncagctctggattcaccttgatatgatangcagtggccacnggctcaggcgagggctggacggtgggnggcaggtgngtctatttccagtcggaagtaatcaagttcgtacgggtgtagttcccggttaggacggtcgtattccaccgtatactccgagtacgaactaacgttccgaagtaacgactagtacgttacttacctttaaanaacgtacgaacgacgtaccgtagaaccgtaccgtacgaacggaccgtacggtaccgtttaggtttacgtttacggacggtacggtagtaacgttacgttacgttacgtttaacgtaaacgtttcgttacgtacgtaccggtacggtaccggtacgggtaccg

SEQ ID NO: 425231 - DNA, 684 bp, Homo sapiens
  misc_feature: GZ8MTXP02F5I0S.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcattgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctcgtggtattcaccttcgaataaagttggaaatagtgcctaggtcgggtcccgccgaggcctccgaggcggaggggctgggagtggggtggcgtagggtgtgtcatttccgagtggaaggaaaattcgaaagttcgtacgggtgagtttccggtggacggggtcccgtattcccgaaccctatacctaccgaagaacgaacctaaacgttacccgaaagtaaaccacaagttcgtacttacttaacaaaacgtagaaacaacgccctagacgaccgtacgaaggaccgacggtaccgttaggtttaagtttttacggtcggtacggtaacgtaccttaacttaccgtttacgtttaaaccgtaaaacgtttccggttaacctacgtttaccggaaccggtcccggtacgggggtaaccccggg

SEQ ID NO: 425232 - DNA, 589 bp, Homo sapiens
  misc_feature: GZ8MTXP02HUQRH.44.27.C05.1.454.CMB.2.raw
  modified_base (376)..(376): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctctggacttcaccttcgataatggaatatgcagtcggtccgcaggctccgaggcggagggctggagtgggtgcgaggtgtgctatttccagtggagaaatgaagttctaggtntacttccggtgacgggtcgtattccactatctacgagacgaactaacgttaccgaagaacactacgtcgtacttacctaacaaattacgaactacgaccctagaccgacgtacgacggacacggtcgtagtttacgtttggtgacgtagtactacgtcgttacgttactaaaacgttcggttactacgtcgaccgtccggtacggtaacccgg

SEQ ID NO: 425233 - DNA, 712 bp, Homo sapiens
  misc_feature: GZ8MTXP02GOTR9.44.27.C05.1.454.CMB.2.raw
  modified_base (187)..(187): a, c, t, g, unknown or other
  modified_base (220)..(220): a, c, t, g, unknown or other
  modified_base (282)..(282): a, c, t, g, unknown or other
tcagacagtatatacacgaccggtgctcgatttagacgcgatcgaagggtctggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccatctcctgcactgganccagcggtaatattcttagtcttaattgtctcctggtatcaacatcataccaaggtaaaccncccccaaatcatcatctatgaggcctaataagacggtccctgttacggggtttactaagtccgtcttccgacctcgaccctaccgaacggtcccgaccaccgaccgggtcccctacccgtacgaacctaacttccgtcgtcggggtacccttccggaaggtccgtaggacgggtacgacggggtctaggttaatttaagttgtttagttcgtacgttacgtaaggtactttcggttcgtaccgctaacttaccgtaactttgtcggtttaccggttacgggtaaacgggttaccgggtaaacccgtaaacgggttaccccgtaacccggtttccggtaaaacgggttcccgaaacccggtaaccccgtaaaacccgggaccccctaaaaacccccgtcgtaccggttaaccctaacccgttttcccccgg

SEQ ID NO: 425234 - DNA, 538 bp, Homo sapiens
  misc_feature: GZ8MTXP02JA8IH.44.27.C05.1.454.CMB.2.raw
  modified_base (189)..(189): a, c, t, g, unknown or other
  modified_base (223)..(223): a, c, t, g, unknown or other
  modified_base (235)..(235): a, c, t, g, unknown or other
  modified_base (280)..(280): a, c, t, g, unknown or other
  modified_base (361)..(361): a, c, t, g, unknown or other
  modified_base (396)..(396): a, c, t, g, unknown or other
  modified_base (421)..(421): a, c, t, g, unknown or other
  modified_base (434)..(434): a, c, t, g, unknown or other
  modified_base (525)..(525): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatnttcttagtcttaattgtctcctggtatcaacatcatcagtaaacnccccaaatcatcatctatgaggcctaataagacgccctagaggggtttactaagtcgcttcacctgcctcagtccgcaacncggcctccctgacaatctactggcctcagctgagngagctagtacttatattgtagctanagtatgttcgtcnctatctaacttgtcttcgtaggagtacgggacctaggtcctaccgtcgtacggtaccacggacccaacggcccctaacccgcgtacgtacnccgtctttccccg

SEQ ID NO: 425235 - DNA, 744 bp, Homo sapiens
  misc_feature: GZ8MTXP02F7F0P.44.27.C05.1.454.CMB.2.raw
  modified_base (303)..(303): a, c, t, g, unknown or other
  modified_base (343)..(343): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctcctgtgcagcctctggattcaccttcgataattggaatatgcagtggtccncaggctccgaggcgagggctgggagtgggtggcgaggtgngtctatttccagtgggaaagaaatcgaaaggttctacggggtagtacgtttcccggttagacgggggtacctagtttacccaaacctacgttacccttacccgaaaggtaacgtaaacgtaaacgttacccggaaaggaaaacccaacgtaaacgttcggtttacccttacctttaaactaaaaacgttaacgaaaaccgaaacggtacccgttaacggtaaaccggaaccccgttaccggaaacgggaacccgaacccggggtaccgtttacggtttacgttttttacggtaggtaccggtaaagtaaccctttattaccgtttacgtttaaacccgtaaaaagtttccggttaacttacgttaccggtaaccggtcccggttacgggggtaaaccccgg

SEQ ID NO: 425236 - DNA, 652 bp, Homo sapiens
  misc_feature: GZ8MTXP02HCTG8.44.27.C05.1.454.CMB.2.raw
  modified_base (264)..(264): a, c, t, g, unknown or other
  modified_base (273)..(273): a, c, t, g, unknown or other
  modified_base (294)..(294): a, c, t, g, unknown or other
  modified_base (341)..(341): a, c, t, g, unknown or other
  modified_base (394)..(394): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggaggcgtcggccccgaggtacgggggtccctgagactctcctgtgcngcctctggnttcaccttgataattggaatntgcaggtcggtccgcaggcctccgaggcggaggggctggaggtgggnggcgagggtgtgtctatttcgagtaggaggaaatcgtaaagttctacggggtntaacgttccggttaggacggggtcctagttcccaccgtatcctccaagacgaactaacgtccgaagaaccactagtcgtacttacttaacaaattagaaaccagtaccctagaccgacctacgaacggaccgacgggtccgttaggtttaagttttcggacggtaccgtagttaaccttacgttaaccgtttcgtttaaacctaaaagtttccggttactacgtttaccggaccggtcccggttacggggaaccccgg

SEQ ID NO: 425237 - DNA, 559 bp, Homo sapiens
  misc_feature: GZ8MTXP02H06FU.44.27.C05.1.454.CMB.2.raw
  modified_base (189)..(189): a, c, t, g, unknown or other
  modified_base (223)..(223): a, c, t, g, unknown or other
  modified_base (234)..(234): a, c, t, g, unknown or other
  modified_base (355)..(355): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttctagtcttaacttgctctgtatcaacatcatccagtaagccccaaactcatcatctatgaggcctataagacgccctgtagggtttctaatcgcttcacctgcctcaagtccgacaacncggcctcctgacaatctctgggcctcgagctggacggacgaggtctagtatttattattgttcgtctcagtattcgttcgtcgctatctacgttatcgttacgttacggtaaagtcgggaaaccgtaaggtaccaccggttacctacgggtccaacgacccgtaaacggaccccaacccgtacgtcgtaccactttcgttcccg

SEQ ID NO: 425238 - DNA, 626 bp, Homo sapiens
  misc_feature: GZ8MTXP02I4IVB.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctggattcaccttcgataattggaatatgcagtgggtccgccaggctccgaggcgaggggctgggaggtggggtggcgagggtgtgtctattccagtggaggaaatcaagtctacggtgattccggttgagggcctagttccaccatctccagacgacaatccgagaacacagtgtactctacaaatagaacacggacctagacgacctcgacggaaccgtacgggtcccgttagtttaagtttttcggtcggtacggtacggtaacttacgttaccgttacggttttaaccctaaaaacgttaccggtttaccgtacgtttaccggtaacccggttcccggtacgggggtaacccccggg

SEQ ID NO: 425239 - DNA, 733 bp, Homo sapiens
  misc_feature: GZ8MTXP02HBOIM.44.27.C05.1.454.CMB.2.raw
  modified_base (189)..(189): a, c, t, g, unknown or other
  modified_base (221)..(221): a, c, t, g, unknown or other
  modified_base (263)..(263): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcatgganccagcggtaatattctagtcttaacttgtctctgtatcaacntcatccaaggtaaacacccccaaatcatcatctatgacgacctaataacgacggtccctgtacgggtttctaaatccgtcttcacctcgcctaccgaagtcccggacaaccgccggcccttccctagaaacctaacgttccgtccggttcggggacccttaccggacgggtcgtacggggaacggggaacggacggggttacctagggttaaatttttaacgtttacgtttgggtttacggtccctttacgtaggttaacgtttccgggtttaccgggtacccgtactaacgttaccttaacgttttagttcggtttaccggtttaacgggaagggttaccggggtaaacccttaacggggtaccctaccccggttaacggttaccgggacctaacccggacccggtaaacccggacccccaaaacccccgttactaccggtaccctaaccctttcccgtttaacccccg

SEQ ID NO: 425240 - DNA, 735 bp, Homo sapiens
  misc_feature: GZ8MTXP02JIAEZ.44.27.C05.1.454.CMB.2.raw
  modified_base (308)..(308): a, c, t, g, unknown or other
  modified_base (342)..(342): a, c, t, g, unknown or other
tcagacagtatatacacgaccggtgctcgatttagacgcgatcgaagggtttggggcgtgggagacgagcccagcactggaagtcgccggtgtttccactcggtgatcatcactgaacacagaggactcaccatggagtttgggctgagcgtggttttcgtcgttaggcccgtcttaagtaggtgtcatgtgtcaggtgcaattcgtggagtcgtgggggaggcgtggcccccaggtaggggggtccctgagacctctcctgtgcagcctctggatcaccttgataattggaatatgcaggttggccncaggctccgaggcgagggctgggagtgggtgcgnggtgtgtcgtattccgtagtaggtaaggaaagtacgtaacgttacgtacggtgttaacgttccggtttacggttacggggaccgggtacgttacgtaaccctacgttacctaccctagaacgaaaccgtaacttaccgtaacggtaaacgtaaccaaggtacgttacgttccgttaaccgtaaacgttaaacgtaaacgtacgtaccgtacgtaaccgtaaccgtaccgtaaccggtaacccggtaaccggtaccggttacggtttacgttttacgttacggtacggtaacgttaacgtttacgtttaccgtttaaccgtttaaaccgttaaaacgttaaccggtttaaccgttacgttacccggtaccggtacccggtaccggggtacccgg

SEQ ID NO: 425241 - DNA, 589 bp, Homo sapiens
  misc_feature: GZ8MTXP02IQN2D.44.27.C05.1.454.CMB.2.raw
  modified_base (311)..(311): a, c, t, g, unknown or other
  modified_base (392)..(392): a, c, t, g, unknown or other
  modified_base (507)..(507): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacgggggtccctggagactctcctgtgcagcctctggattccaccttcgataagttggaatatgcaggtcgggtcccncaggctccgaggcggaggggctgggagtggggtgcgtaggtgtgtctatttccgagtggagaaatcgaagttctacgggtntacgttccggtgacgggctattccactatctccaagagactactaccgaagaacacagtcgtctctacaaatgaacagctagacgactcgagacgacggtcgtagttacgtttgngtacgacgtactacgttacgttacgtttaactaaaacgttcgttactacgttaccggtaccgtaccggttacgggaacccgg

SEQ ID NO: 425242 - DNA, 663 bp, Homo sapiens
  misc_feature: GZ8MTXP02F58CP.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcggtggagtcgtgggggaggcgtggccccgagggtacgggggtccctgagactctcctgtcgcagtcctcgtggacttcaccttcgaattaattgggaaatagtgctaggtcggtaccgcgaggcctccgaggccggaggggctgggaggtggggtggcaggggtgtgtctagtttcgagttaggaaggtaatcaaggtcgtacggtgtacgtttccgtggacggggtcctattacccgaacctactccgtaccgaagtacgtaaactaacgttaccgaaacgtaaacgaccgtagttacgttaccttacttaaaccgtaaatacgaaacgacgtacccaggaactacccgtaacgacggaaccgtacgggtccgttaggtttacgttttaggcgtacggtactacgttactcgttacgttaacctaaagttcgttactagtccgacgtcgtaccgggg

SEQ ID NO: 425243 - DNA, 625 bp, Homo sapiens
  misc_feature: GZ8MTXP02JEQQT.44.27.C05.1.454.CMB.2.raw
  modified_base (269)..(269): a, c, t, g, unknown or other
  modified_base (305)..(305): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctntggattcaccttgatattggaatatgcagtggtccncaggcctcgaggcggaggggctgggagtggggtggcgaggtgtgtctagtttcagtggaaggaactcgaagtcgtacgggttgtaacgtttccgtaggaacgggtccgtaactttaccgacctatcctaccgagtaaacgactaacgttaccgaagtaaacacgtagttacgtacttacttaactaaatacgaacagaccgtagacacctacgaggaccgacggtccgttagttacgttttgcggtacgaacgtactacttccgttagttaacccgtaaagttccgttactacgttaccggtaccgtcccggtaccgggg

SEQ ID NO: 425244 - DNA, 530 bp, Homo sapiens
  misc_feature: GZ8MTXP02I6ORM.44.27.C05.1.454.CMB.2.raw
  modified_base (189)..(189): a, c, t, g, unknown or other
  modified_base (223)..(223): a, c, t, g, unknown or other
  modified_base (266)..(266): a, c, t, g, unknown or other
  modified_base (361)..(361): a, c, t, g, unknown or other
  modified_base (371)..(371): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaacttgtctctgtatcaacntcatcagtaaacgcccccaaatcatcatctatgagcctataagaggccctgagggtttctaatccgcttcacctcgcctacaagtccggacaacncggccctccngacatctctgggctcgaggctgacggagaggctgatttattattgtgctagagtattgttacgtcgacattcgactttatcgttacgttaggacgtcgggacctaaggtccaccgtcgtaggctaagtgttcgactcgaaggaaatcgaacgaggaggg

SEQ ID NO: 425245 - DNA, 653 bp, Homo sapiens
  misc_feature: GZ8MTXP02IX8M3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagactctcctgtgcagcctctggacttcaccttcgataattggaatatgcaggtcgggtcccgcaggctccgaggcggaggggctgggaggtggggtggcgagggtgtgtctatttccgagtgggaaggaaatcgaaaggttctacgggtgtaagtttccggttggacggggtcctattcccgacctactccgtaccgagaacgaacgtaaacgttacccgaaagaaaccaacgtagtcgtaccttacttaacaaattacgaaactacggaccccgacgaccctacgacggaccgacggtccgttagttacgttttggtcgtacgtacgtacttacttacgttacgtttaacctaaacgttccggttacgtacgttacgaccgtccggtacgggtacccgtaaccggg

SEQ ID NO: 425246 - DNA, 538 bp, Homo sapiens
  misc_feature: GZ8MTXP02FSULZ.44.27.C05.1.454.CMB.2.raw
  modified_base (304)..(304): a, c, t, g, unknown or other
  modified_base (481)..(481): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtaggggggtccctgagactctcctgtgcagcctctggattcaccttcgataattggaatatgcagtgggtccncaggctccgaggcggaggggctggagtgggtggcaggtgtgtcatttcatggagaaatcaagtctacgtgattccgtgaggccgattcacatctccagagacaattcgagaacacagtgtctcttacaaatgaaacagacctgacgtacctacaggacacggccgtagttattttgngacgagtactactcttagttaactaaaactcggttactacttacgacgtcgtacggg

SEQ ID NO: 425247 - DNA, 754 bp, Homo sapiens
  misc_feature: GZ8MTXP02HYET1.44.27.C05.1.454.CMB.2.raw
  modified_base (174)..(174): a, c, t, g, unknown or other
  modified_base (198)..(198): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctnttaagaggtgtcatgtgtcaggtncaattcgtggagtcgtgggggaggcgtcggccccgagggtacgggggtccctgacgtactctccgtgtcgcacgcctctggacttcaccttcgaattaagtggaatatgctaggtcggtcccgccagggcctcccggagggcggaggggctggggaggtggggtggcgtaggggtgtgtctagttttcgaagttgggaaggtaaatcgaagttccgttacggtgtacgtttcccgtagcggggacctatccacctatccaccgtaagacgtaactaaacgttcccgaaggaaaacctacgtaacgttagttacccttacgtttaacctaaaagttaccgaaaccgaaccggtccgttaacggaaccgttaaaccccgtcggaaaccgggtaaccgtacccgggggttacccgtttacggtttttaaggttttttccgggaacggttaccggtaacgttaccttaaccgttttacgtttaccgttttaaaacccgtaaaacgttttccgggttaaccttacgtttacccggacccggtttaacccggtcccgggggg

SEQ ID NO: 425248 - DNA, 658 bp, Homo sapiens
  misc_feature: GZ8MTXP02G6A1M.44.27.C05.1.454.CMB.2.raw
  modified_base (174)..(174): a, c, t, g, unknown or other
  modified_base (269)..(269): a, c, t, g, unknown or other
  modified_base (297)..(297): a, c, t, g, unknown or other
  modified_base (310)..(310): a, c, t, g, unknown or other
  modified_base (398)..(398): a, c, t, g, unknown or other
  modified_base (500)..(500): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcggtggagtcgtgggggagcgtggccccaggtacgggggtccctgagactctcctgtgcagcctcnggtattcaccttcgaataagttggaatntgcaggtggtccncgaggctcgaggcggaggggtctggaggtggggtgcgtaggtgtggtctagtttcgagtaggaaacgtaatcgaaagttcgtacggtntacgttccgtaggacgggtccacgttacaccctaattccacgaggaacactaaacgtaccgaacgaaacacgtaagttactactacttaacaaaatcggaanaacgcccgtagacgttaaccgacgaacggaaccgtaccggtaccggttagttttaacgttttgaggtaccggtaaagtaccgttacttacgttaaccgtttaaaacgaaacggtttaccggtactaaacgtttccggaacggtcccggttaaccgggg

SEQ ID NO: 425249 - DNA, 606 bp, Homo sapiens
  misc_feature: GZ8MTXP02HJ2CE.44.27.C05.1.454.CMB.2.raw
  modified_base (246)..(246): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgttagaaaatntaaccttgtctcttggtaccaagtactacccaacggtaaaccccccaaactccttctttatgaagtcaatagcggccctcgggctatttctcatcgtcttctcaggtctccaagtcctggacaacgacggtcctcgttgattaactttcgtcgtcctcctcgcctcgacgacgacggccgaactattatgctgctacatatgcggtctagtattagttcgggtacttcggggcggagggtaccggtcgtcggaaccgtccgtaacggtccgacgacccggtaacggcctccggcccccgtcgggtacctaccgttccgttccgttcccccgtccccttccttccttaacttacgtttccg

SEQ ID NO: 425250 - DNA, 710 bp, Homo sapiens
  misc_feature: GZ8MTXP02JL336.44.27.C05.1.454.CMB.2.raw
  modified_base (297)..(297): a, c, t, g, unknown or other
  modified_base (311)..(311): a, c, t, g, unknown or other
  modified_base (398)..(398): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctggagactctcctgtgcagcctctggattccaccttcgataattggaattangcaggtgggtcccnccaggcctccaggcgtaggggctgggacggtggggtggcgagggtgtggtctattccgatgggaagtaaatcaaggtctacggggtntagtttccggtgacgggtccgatttccacctatcctaccgacgacgaaccgaacttacccggaacgtaaaccaacgtaacgttcgttacccttacttaacctaaaacttacggaaaacctaacggtaccccgtagtaacggtaacccgttaccggaaacgggaacccggtaaccggggtaccggttccggttttaaaggtttttcggtacggtaccgggtaaagttacgttaacgttaccgtttacggttaaccctaaaagtttcccggttactacggttaccgtaccggtcccggtacgggggtaccccgg

SEQ ID NO: 425251 - DNA, 601 bp, Homo sapiens
  misc_feature: GZ8MTXP02GKQPF.44.27.C05.1.454.CMB.2.raw
  modified_base (311)..(311): a, c, t, g, unknown or other
  modified_base (341)..(341): a, c, t, g, unknown or other
  modified_base (347)..(347): a, c, t, g, unknown or other
  modified_base (586)..(586): a, c, t, g, unknown or other
tcagacagtatatacacgaccggtgctcgatttagacgcgatcgaaggggtttggggggggtcacaagaggcagcgctctcgggacgtctccaccatggcctgggctctgctgctcctcactctcctcacccaggacacagggtcctgggcctagtctgccctgactcagcctgcctccgtgtctgggtcgcctggacagtcggtcaccatctcctgcactggagccagcggtaattattcttagtcttaacttgtctctggtatcaacatcatccaaggtaacgcccccaaatcatcatctatgagctanagcgccctgagggtttctaatcgtcttacnccgtcncctacgacgtccggacaacgccggccctacccgtagaccaactctccgtcgggtcctacgtaggccgtgacggacgacggcttagtatttattagttgttgctacgagttagttcgtttccgtacgactacttctactttagtcgtttacgttagggaacgtcgggaacccgttaaggtccctaaccggtccgtacgtacccgacgaccccgaacggtccccaacccgtctacgtaccnccgttcgttcccccg

SEQ ID NO: 425252 - DNA, 650 bp, Homo sapiens
  misc_feature: GZ8MTXP02HBPP0.44.27.C05.1.454.CMB.2.raw
  modified_base (482)..(482): a, c, t, g, unknown or other
  modified_base (501)..(501): a, c, t, g, unknown or other
  modified_base (509)..(509): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggcccaggtacgggggtccctgagactctctgtcgcagcctctggacttcaccttgataattggaatatgctaggtcggtcccgcgaggcctaccggagggcggaggggcgtaggggaggtggggtggacgtagggtgtgtctatttccgaaggtaggtaaggaaactcgtaaaggttcgtacgggttgtacgtttccgggttaggacggggtcctactaccactacgtccctagaagacaactacgtacccgaagtaacncgtagtctacttacctaanatacaacncgacgtacgacacgtagaacggtaccgacggttacgttggtttaacgtttggacggaaccttagtaacctttagttaccgttacgttttaaaccaacgttcgtaccttacggtcgtaacccggtcggtaccggggacccgg

SEQ ID NO: 425253 - DNA, 743 bp, Homo sapiens
  misc_feature: GZ8MTXP02HEO4M.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggcccgaggtacggggggtccctggacgactctccgtgtgcagcctctggacttcaccttcgataaacgttggaatatgctaggtcgggtcccgcgaggcctccgaggcggaggggctgggaggtggggtggcgaggtgtgtctagttccgagtggaagtaaactcgaaaggttcgtacgggtgtacgttcccggttaggacgggtccgaattcccaaccgtactccgtaccgaaggaacgtaaaccgtaaacgttaccggaaacgtaaacctaacgtacgttacgttaaccttacccgtttaaactaaaacgttacgaaaaccgtacggtaaccccgtaaggtaaccgtaaaccccgttacggtaaacgggaacccgttaaccggggtacccgtttacggttttaacgtttttacgggacggtaaccggtaaacgtacgttacgttaccgttaccgtttaaaacctaaaacgttcggttactacgtttaccggaccgtaccgggtacgggtaaccccgg

SEQ ID NO: 425254 - DNA, 720 bp, Homo sapiens
  misc_feature: GZ8MTXP02IK9V2.44.27.C05.1.454.CMB.2.raw
  modified_base (391)..(391): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtgggggagcgtcggccccgaggtacggggggtccctgacgactctcctgtgcagcctctggattcacttcgataattggaatatgcgagtcgggtcccgcgagctccgaggcgaggggctggagtgggtggcgaggtgtgtctatttccagtggaaggtaaatcgaagttctacggggtnagtttcccggtgacgggggtcctagtttacccaacctagtacccttacccgaagtacgaaccgtaaacgtttacccgggaaactaaaacgtaccgtaaagttcggttaaccctttacctttaaacccgtaaaattaccggtaaacaacggtacccgtacgaacgtacccgtacggaaacggacctaacggggtcccgttaggttttactttttgggacgtacggttaacgtaaccgttacttacccgtttacggtttaaaaccctaaaacgttccggtttaaccgttacgttacccggtaacccgtccgggtaccggggtaaccccggg

SEQ ID NO: 425255 - DNA, 652 bp, Homo sapiens
  misc_feature: GZ8MTXP02FQP3J.44.27.C05.1.454.CMB.2.raw
  modified_base (274)..(274): a, c, t, g, unknown or other
  modified_base (308)..(308): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgacgactctcctgtgcagcctctggnttcaccttcgataattggaatatgcagtggtccncaggctcaggcgagggctggacgtggggtggcgaggtgtgtctagtttcagtggaaggaaatcgaagttcgtaacggtgtaacgtttccgtaggacggggtccgtatttaccgactacgttcctacccgaagaacgtaacaaccgtttaccgaaacgaaacacgtagttcgtaccttacgttaacaaagttacgaaacgtacgtaccgtacgaacgtacccgtacgacggaaccgtaccgggtacgttacgtttaacgtttttggacggtacgacggtacttacgtactttacgttaaccgtaaaagttcggttactacgtttccgaaccggtcgtaaccgggg

SEQ ID NO: 425256 - DNA, 770 bp, Homo sapiens
  misc_feature: GZ8MTXP02GVKSD.44.27.C05.1.454.CMB.2.raw
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccaggtagggggtccctgagactctcctgtgcagcctctggattcaccttcgataattggaatatgcagtgggtccgccaggcctccgaggcggagggggctgggaggtggggtggcagggtgtgtctatttcagtaggaaggaaatcgaagtccgtaggtgtatttccggttgacggtccattccaccagtcctaccgagacgtaactaacgttccgaagaaaccaacgtaggttacgtccttacttaccaaaaattccggaaaactacggcccgtagaacgtacccctacgacggggtaccaccggggtccgtttagtttaagttttttcgggagtaccgtaacgtaaacgttacgtttcctttaacggttttaaaccctaaaaacgtttccgggtttaccctaacgtttaccccggaaccgggtacccccggtacgggggtaaccccgtaaccgggggtaaacccccgtttcgggttacccgtaccccgtttccgttccccgtaccgggtccccttaccccgaaccgtaaccgggccctacgtcccgttcccgttcccccgtcggcccgtccccgttgcccgtaccgaacggctccgaacccgtccgagacgccgaacgcggcccggtccg

SEQ ID NO: 425257 - DNA, 552 bp, Homo sapiens
  misc_feature: GZ8MTXP02FFGQC.44.27.C05.1.454.CMB.2.raw
  modified_base (255)..(255): a, c, t, g, unknown or other
  modified_base (303)..(303): a, c, t, g, unknown or other
  modified_base (374)..(374): a, c, t, g, unknown or other
  modified_base (430)..(430): a, c, t, g, unknown or other
  modified_base (439)..(439): a, c, t, g, unknown or other
  modified_base (463)..(463): a, c, t, g, unknown or other
  modified_base (489)..(489): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctgagactctccngtgcagctctggattcaccttcgataattggaatatgcagtgggtccnccaggctccaggcgaggggctgggagtgggtgcgaggtgtgtcatttcatgggaagaatcaagtctacggngacttccggttgagggccgattccacctatctccagagacaatcccgaagaaacanacgtgtctnttacaaatgaacagcctgacgacncgaggacacgggcgtagtagttttgngtcgagacctagtctagtttaccaaaagttcggttactacgttcgacgccgtacggggacccg

SEQ ID NO: 425258 - DNA, 630 bp, Homo sapiens
  misc_feature: GZ8MTXP02JNWX0.44.27.C05.1.454.CMB.2.raw
  modified_base (330)..(330): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagcctctggattcaccttcgataattggaatatgcagtgggtccgccaggctccaggcgaggggctgggagtgggtgcaggtgtgtcatttcatggagaaatcaagtctacggtgattccgtgaggccgattcacatctccagagacaattccgaagaacanagtgtctcttacaaatcgaacacgcctagacgacctcgaggaccacgggccgttagttatttttggcgcgagtactagttctacgtttacctaaaagttcgttacagttcgacgtccgtggggtaccgacgggtaacccgtggtaccaccgttcctaccgtccggccctcccgaaccgacgggacccctacgtcccggtcccttcccccgtcggcccgtccccgtcgtcccgttacccgacggaccgacccgaacccgtacccggaacggaccgaccgaccgaaccggccggtccccggg

SEQ ID NO: 425259 - DNA, 671 bp, Homo sapiens
  misc_feature: GZ8MTXP02G186O.44.27.C05.1.454.CMB.2.raw
  modified_base (306)..(306): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtaggggggtccctgagactctcctgtgcagcctctgattcaccttgattattggaatatgcagtgggtccnccgaggctccgaggcgaggggtctgggaggtggggtcggcagggttgtcggtctagtttcgagttgggaacggtaaaatccgtaaaggttcgtaacgggtggtactttcccgggttaggaacgggggtcccattaccgactacttcctaccgagaacgaactaacgttaccgaacgaaacaccgtagtaggttacctactttaacaaaataggtaaaccgtaaccgtaccgtagaaccgtacccgtacgaacggtaccgaccggttcgttagtttacgtttggacggtacgtacgtacgttacgttacgttacgttaaccgtaaacgttcgttactacgttaccggtaccggtaccggtacgggg

SEQ ID NO: 425260 - DNA, 593 bp, Homo sapiens
  misc_feature: GZ8MTXP02J2JNY.44.27.C05.1.454.CMB.2.raw
  modified_base (334)..(334): a, c, t, g, unknown or other
  modified_base (341)..(341): a, c, t, g, unknown or other
  modified_base (343)..(343): a, c, t, g, unknown or other
  modified_base (345)..(345): a, c, t, g, unknown or other
  modified_base (353)..(353): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtcgtgggggaggcgtggccccaggtacggggggtccctgagactctcccgtgtgcagcctctggattccacttcgattaattggaatatgcaggtggtccgcaggctccgaggcgaggggctggggnggtgggngngnggtgtgtntatcgtagtaggagaatacgagtacgtcggtagtacgtcgtgtacggacgtactacactactactacgagaacaacgtacgtacgaacgaacgtacgtacgtcgtactactaactaaatacgaacgacgtacgtacgacgacgtacgacgacgacgtcgtcgttacgttgtgtacgtacgtactactacgttacgttaacgtaacgtacgttactacgtacgtacgtaccggtcggaccg

SEQ ID NO: 425261 - DNA, 621 bp, Homo sapiens
  misc_feature: GZ8MTXP02FLGXN.44.27.C05.1.454.CMB.2.raw
  modified_base (189)..(189): a, c, t, g, unknown or other
  modified_base (223)..(223): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcggtaatattcttagtcttaactttgtctcctggtatcaacatcataccaaggtaaacacccccaaactcatcatctatgagcctaataagacgccctcgtaggggtttcaatcgcttcacctcgcctcaacgtccgacaacgccgcctcctagacaatctcgtgggctccgaggctggacggacgagctagtatttattagttgttgtctcgtagtattcgttcgtcgtactattactactttagtcgttacgttacggggtaaaggtacggggtaacccgtaaacgggttccgtaaacccggttaccgttaacgggtaccgaaccgtacccccgaaaacgggaccccctaaaaccccgtacgtccggtacccaacctttcgtttaacccccg

SEQ ID NO: 425262 - DNA, 646 bp, Homo sapiens
  misc_feature: GZ8MTXP02GG8E6.44.27.C05.1.454.CMB.2.raw
  modified_base (302)..(302): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccncaggctccaggcgaggggctgggagtggggtggcgaggtgtgtctatttccgagtgggaaggaaaatcgaaagttctacggggtgtacgtttccggttaggacggggtcccgtatttccgaccctattccctacccgaagacgaacctaaagttcccggaagaaacccactaacggttcgttccttactttaccaaaattcgaaacctaggaccctaggaaccgaccctcgaaacggaccgacgggtccgttggtttacttttaggtggtaccgtagacttacgtacttacgtttacctaaaagttcggttactacgttaccgaccgtccggtcgggtacccgg

SEQ ID NO: 425263 - DNA, 559 bp, Homo sapiens
  misc_feature: GZ8MTXP02H4C7X.44.27.C05.1.454.CMB.2.raw
  modified_base (202)..(202): a, c, t, g, unknown or other
  modified_base (369)..(369): a, c, t, g, unknown or other
  modified_base (437)..(437): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcacatggagtttgggctgagctgggttttcctcgttgccctcttaagaggtgtcatgtgtcaggtgcaattcgnggagtcgtgggggagcgtggcccaggtacggggggtcctgagactcgtctgtgcagctctggatcacttcgataatggaatatgcagtggtccgcaggctcgaggcgagggctggagtggggtgcgaggtgtgtctagtttcagtaggaagaatcaagttctaggtntaagttccgtgacggccgattccacatcaccagacgactaactacgaagaacacgagtctactactanaaatagaacacgctaggacactacgacgacgacggtacgtagtttacgtttgcgacgagtacttagtcttacgttacctaaaagttcggtactacgttacgacgtaccggtacggaacccgg

SEQ ID NO: 425264 - DNA, 675 bp, Homo sapiens
  misc_feature: GZ8MTXP02F39D8.44.27.C05.1.454.CMB.2.raw
  modified_base (327)..(327): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggatcacctgataatggaatatgcaggtcggtccgcaggctccgaggtcggaggggtctgggnggtggggtggcgtagggtgtgtctagtttccagtgggaagtaaactcgtaaagttccgtacgggtgtacgtttccggttaggacggggtacctagtttccaacctaactcctaccgaagacgaaacctaacgttacccgaagaaaccacgtaacggtcttaccttaccttaacaaaacttagaaacctacgtacccgtagtaaccgaccgttacgaaggaccgtacgggtacccgttagtttacgtttttaggcgtaggaacgtacgttactttacttacgttttaaaccgtaaaacggtttccgttacgtaccgtttacgacccgtaccgggttacggggaccccgg

SEQ ID NO: 425265 - DNA, 590 bp, Homo sapiens
  misc_feature: GZ8MTXP02I7DHS.44.27.C05.1.454.CMB.2.raw
  modified_base (189)..(189): a, c, t, g, unknown or other
  modified_base (288)..(288): a, c, t, g, unknown or other
  modified_base (458)..(458): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatcctcctgcacgtggagccagcggtaatattcttagtcttaactttgtctcctggtatcaacatcatccaacggtaaacnccccaaactcatcatctatgacgcctaatagacgtccctgagggtttctaatcgtcttcaccctgccctccaacgtccggacaacgccggcctcctgacatctcgtgggctcgaggctgagagagctagtattattagttgttgacttgagttattcggttcgtaccgtntacttacgtaactttagtcgttacgttacgggtaacggtacgggaccgtaaacgtccgtaaaccgttccgtacggtacccgacgacccgaaaccgccccgaaaccctctaccgtaccaccgttccgttcccg

SEQ ID NO: 425266 - DNA, 713 bp, Homo sapiens
  misc_feature: GZ8MTXP02HK3Y8.44.27.C05.1.454.CMB.2.raw
  modified_base (314)..(314): a, c, t, g, unknown or other
  modified_base (370)..(370): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagctctcctgtgcagcctctggattcacccttcgaattaattggaaatagtgcgaggtgggtcccnccgaggcctccgaggccggaggggcgtgggaggtggggtggcgtagggtgtcgtcntttcagtggaaaggtaatcgaaggtcgttacgggtgtacgtttccggttgaacgggggtcctaattccgacctactccttaccgagtaacgtaacctaaacgttccggaaacgaaccaaaccgtaaggttactccttactttaaacctaaaattaacgggaaacaaacgttccctaacgggaactacccgttaacgaaccgggaaccgtaaccgggttacccgttcggtttaacgtttttggaccggtaggtaaccgttaacgttactttcggttaacgtttaaccctaaaaacgtttccgggttactaaccgtttcggaaccggttaccgggtacccggggg

SEQ ID NO: 425267 - DNA, 613 bp, Homo sapiens
  misc_feature: GZ8MTXP02IYR03.44.27.C05.1.454.CMB.2.raw
  modified_base (180)..(180): a, c, t, g, unknown or other
  modified_base (461)..(461): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagnggtgtcatgtgtcaggtgcaattcgtggagtcgtgggggaggcgtggccccgaggtacggggggtccctgagactctcctgtgcagcctcgtggattcaccttcgaattaattggaatatgcgagtgggtccgcaggctccgaggcggagggctgggaggtgggtggcgaggtgtgtctagtttcagtggaaggaaatcgaagtcgtagggtgtacttccggttggacggggcctatccgacctactctaccgagagacgacttacgaacgaacacgagtntacgttactactaaatacgaacgacgactacgacgacctacgacggacgacggtaccgttacgttacgttttaggtcgtacggtagtacgttactcgttacgttaacctaaaacgttccggttactacgttccgaccgtccggttaccgggg

SEQ ID NO: 425268 - DNA, 655 bp, Homo sapiens
  misc_feature: GZ8MTXP02FMD86.44.27.C05.1.454.CMB.2.raw
  modified_base (272)..(272): a, c, t, g, unknown or other
  modified_base (344)..(344): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctgagactctcctgtgcagcctctggnttcaccttcgataattggaatatgacgagtggtccgccaggcctccgaggcggaggggcgtggaggtggggnggtcgaggtggtgtctatttcgagtaggaagaaataccgtaaggtcgtacgggtgtaacgtttcccgtggaacggggtcctattccaccgtatccgtaccagaacgaacaacttaccgaacgaacaacctaggtactacttacttacaaatacgaaactacgacctagtacgaccgtacgacggactaccgggtaccgttacgttagtttttagacggtacgtaacggtactttaactaccgttttaacggttaaccttaaaaacggttccggttacttacgttaccgtaaccggtccggttaaccggggg

SEQ ID NO: 425269 - DNA, 598 bp, Homo sapiens
  misc_feature: GZ8MTXP02IBCJ0.44.27.C05.1.454.CMB.2.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggcaccagcagtgacatttggtggttataactttgctctgtaccaacaccaccaggacaaacgccccaaattcatcaatttatgatgtacagtaagcggccctcgaggggtccctgactcgcttcctcgtcgctccaagtctggccaaaccgacggcccttccctgaccccgtctccgtcggggcctccgacggcctaggacgggacgacgggtctagtaacgtttattacgtggtacagcttacattacgtaacgtaaggtacgggaaacttacgtttaactagttcggtcgacgaacgggaaccaggaccgttacggacccgttccgacggtcacgcccgtaaaggccctacggcccccgtcggtcctaccttcccg

SEQ ID NO: 425270 - DNA, 615 bp, Homo sapiens
  misc_feature: GZ8MTXP02IM1A1.44.27.C05.1.454.CMB.2.raw
  modified_base (173)..(173): a, c, t, g, unknown or other
  modified_base (313)..(313): a, c, t, g, unknown or other
  modified_base (401)..(401): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggtttcctcgttgccctnttaagaggtgtcatgtgtcaggtgcaattcggtggagtcgtgggggaggcgtcggccccgagggtacgggggtccctgacgactctcctgtgcagcctcgtggattcacttcgataattggaatatgcaggtcggtcccncagggcctccgaggccggaggggcgtggaggtggggtggcgagggtgtgtctagtttcgagtaggaaggtaatcgtaagtcgtaggtntagttccgtggacggccgtatcacactctacagagaactacttaccgaacgtaacacgacgtagtccttacttacaaatacgaacacgcctagacgtacctacgacgacgacggtcgttacgtttagttttgcgtacgtactacgttacgttcgtttaacgttaaacctaaaacgttcggtttacctaagttccggtaaccgtcggtaccgggg

SEQ ID NO: 425271 - DNA, 678 bp, Homo sapiens
  misc_feature: GZ8MTXP02H4DFV.44.27.C05.1.454.CMB.2.raw
  modified_base (283)..(283): a, c, t, g, unknown or other
  modified_base (293)..(293): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtgagtcgtgggggaggcgtggccccgaggtacggggggtccctggagactctcctgtgcagctctgatcacttgatatgatngcagtggccncgagcctcgaggcggaggggctgggaggtgggtggcgtaggtgtgtctatttccgagtaggagaatcaagtcgtacggtgtatttcccggttggaggggtcccattccaaccctatacctacccgaagacgaacctaaacgttaccgaaacgaaaccaaccgtagttacgtaccttactttaaaccaaagttacgaaaacacggaccgtacgtaaaccgaccgttaccgaacggaaccgtaccgggtacccgttaagtttcgtttttacggtaggttaccgaaaggtacgttaacttaccgttacggtttaaaccctaaaacggttaccggtttaaccgttacggttaccgtaccggtacccggtttacggggtaaaccccgggg

SEQ ID NO: 425272 - DNA, 665 bp, Homo sapiens
  misc_feature: GZ8MTXP02FUL83.44.27.C05.1.454.CMB.2.raw
  modified_base (210)..(210): a, c, t, g, unknown or other
  modified_base (227)..(227): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcacctntctcctgcacgtggacnccgagtcgttaatattcttagtactttaacttgtctctgtactacaatatcactacgaacgtaacgtaccccaaactcatactatctagtacgacgtacctaagtaacggacggtcccgtacgttacgggtttactaacgtcgtacctacaccctccgtaccctaccgtaacgtcccggaccaacgtacccgtccctaccacgtaactacgttcgtcggtacggtcccgtacgacggtcgaggacggtacgacgtacgttagttaactttagtttagttcgttagccttaagtacgtgtttccgttacgacttacacgttacttacgtttacgtcgttacgttacggggaaaggttaccggaaacgttccggtaccgtacccgtacgttccgacgacccaccgaaccgacccaactacgtctactcctacgttccccg

SEQ ID NO: 425273 - DNA, 787 bp, Homo sapiens
  misc_feature: GZ8MTXP02F0ZKL.44.27.C05.1.454.CMB.2.raw
  modified_base (242)..(242): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtcgtgggtcgcctggacagtcggtcaccatcctctgcacgtggacgccagtacggttaattnttcttagttctttaatttcgtctccgttggttatcaactatcactaccgaaggtaaaccaccccctaaactctatctatctagtgaggtactaagtaagacggtccctacggtacggggtttactaacgtcgtccttactccgtccgtaccctaccgtaacgtccgaccaaccgtccgggtccctacccgtacgtaacctaacttcgtcgtaccgggtacctccggacggtcgagggaacggtacggaacggtcttaggttaatttttagttacgtttggttacgtacgttaccgtaaggttacgttcggtttaccggtacgtccgttaaacttacttaaccgtttaagtttcgtaccgggttaaccggggtaacggtttaccgggggaaaacccgtttacggggttacccccggtaaacccgttaccgggtttaccgggtaaccgtaaccccgggaaaccccgtaaaaccccggtaacccccggaaaacccctttacgggttacccgtttaccccacccggttttacccggtttaacccccccg

SEQ ID NO: 425274 - DNA, 756 bp, Homo sapiens
  misc_feature: GZ8MTXP02GS88D.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcggtgggggaggcggtcggccccgaggtagggggtccctgagacctctccgtgtgcagtcctcgtggtattccaccttcgaatattggaatatgcgaggtcgggtccgccgaggcctcgaggcggaggggcgtagggagggtggggtaggcgtgggtgttgtcttagttccgagtagggaagtaaacgtcgaaagttcggtacgggtgtaacgtttccgggttagggacggggtacccgtaactttacccgaccctatcccgttacgaaacgtacggaaacctaacgttacccgaaactaaacgtacgtagttacgttaccttaccttaaacgaaaacgtacgaaccgtacgtacccgtacggtaacgtacccgtacggaacggggtacccgaccggggtaccgtttaggtttaacgtttttcgggacggtaacgggtaacgttaaccttaacgttaccgtttaaccgtttaaccgtaaaacgtttcccggttaacgttaccgttaccgggtacccggttacccggggtaccgggggtaaccccgg

SEQ ID NO: 425275 - DNA, 698 bp, Homo sapiens
  misc_feature: GZ8MTXP02GQF6J.44.27.C05.1.454.CMB.2.raw
  modified_base (194)..(194): a, c, t, g, unknown or other
  modified_base (263)..(263): a, c, t, g, unknown or other
  modified_base (302)..(302): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtncaattcgtggagtcgtgggggagcgtggcccgaggtacgggggtccctgagactctcctgtgcagcctntggattcaccttcgataattggaatatgcagtgggtccncgaggcctccgaggtcggaggggctgggaggtggggtggcgtagggtgtgtctatttcgagttggaacggtaaatcgaaagttcgtacgggtgtacgtttccggttagacgggggtccctaattacccgaccctatcccgtacccaggtaacgaactaaacgttcccggaactaaaccgtacaacggttcgtacctttccgttaactaaacttcgaaaccgacgtaccgacgtaacgtaccgtacggaacggaccggaacggtcccggtttaagtttaacgtttttcgggacgttacggtaaacgtacttacgttaccgtttacggtttaaacctaaacggtttccggtttaactaccgttacggtaacccggtccggttacggggtaaccccggg

SEQ ID NO: 425276 - DNA, 553 bp, Homo sapiens
  misc_feature: GZ8MTXP02HVW39.44.27.C05.1.454.CMB.2.raw
  modified_base (187)..(187): a, c, t, g, unknown or other
  modified_base (221)..(221): a, c, t, g, unknown or other
  modified_base (232)..(232): a, c, t, g, unknown or other
  modified_base (260)..(260): a, c, t, g, unknown or other
  modified_base (275)..(275): a, c, t, g, unknown or other
  modified_base (294)..(294): a, c, t, g, unknown or other
  modified_base (319)..(319): a, c, t, g, unknown or other
  modified_base (334)..(334): a, c, t, g, unknown or other
  modified_base (350)..(350): a, c, t, g, unknown or other
  modified_base (369)..(369): a, c, t, g, unknown or other
  modified_base (527)..(527): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctggtcncctggacagtcggtcaccatctcctgcactgganccagcgtaatnttcttagtcttaattgtctctgtatcanatcatccaagtaacnccccaaactcatcatctangagctataagagccctgtagggttntaatcgcttcacctncctcagtccgacaacncggcctcctagacaatctntcggctcgaggctagagacgagctgtattattattgtgtactctagtagttgttcggtcactactctacttagtcgttacgttacggaaggtcgggtaaccgtaaggtcctaccggttccgtacggtcaccgacccgtaaacggccccaaaccccgtntaccgtacctaccgtttcgttccccg

SEQ ID NO: 425277 - DNA, 668 bp, Homo sapiens
  misc_feature: GZ8MTXP02G6O12.44.27.C05.1.454.CMB.2.raw
  modified_base (293)..(293): a, c, t, g, unknown or other
  modified_base (385)..(385): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtaggggggtccctggagactctcctgtgcagcctctggattcaccttcgataattggaatangcagtggtccgcaggctcgaggcgaggggctgggagtggggtggcgaggtgtgtctatttccgagttggaaggaatcgaagtctacggggtntaagtttccggtgacggggcctattccacgatcctaccagagactaacgttccgagtaacacgatgtactacttacaaatagaacctagaccgtagacgtaccgtacgaacggacccgtacggtacccggtttaggtttaaacgtttttcgggacggtaccggttaaacggttacctttaacgtttaccgtttaccggtttttaaaccgaaaaacggtttcccggtttaacgtaaccgttttaccggacccggtttaccccggtacgggggtaaacccccggg

SEQ ID NO: 425278 - DNA, 679 bp, Homo sapiens
  misc_feature: GZ8MTXP02HIUVI.44.27.C05.1.454.CMB.2.raw
  modified_base (247)..(247): a, c, t, g, unknown or other
  modified_base (270)..(270): a, c, t, g, unknown or other
  modified_base (281)..(281): a, c, t, g, unknown or other
tcagacagtatatacacgaccggtgctcgatttagacgcgatcgaagggtttgggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtagggggtccctgagactctcctgtgcagcctntggattcaccttgataatgaatngcagtggtccncaggctcgaggcgagggctggaggtggggtgcgaggtgtgtctatttcgagtagggaagaaaactcgaaaggttcgtacgggtgtaacgtttccggttaggacggggtcccgtaattccaaccctaatcccgtaccgaagtaacgaactaaacgttaccgaaagaaaccacgaggtctacttacttaaccaaatacgaaacacgacctagtacgaccgtacgaacggacgaccgggtaccgttagtttagttttggacgtacggtaacgtacttacgttacgtttacgtttaaacctaaaacgttcggttacttaacgttaccgaacggtcccggtacggggaacccgaacggggtaaccccgtcggtacccgtacccgttccgtccccgtaccccgg

SEQ ID NO: 425279 - DNA, 592 bp, Homo sapiens
  misc_feature: GZ8MTXP02JC989.44.27.C05.1.454.CMB.2.raw
  modified_base (171)..(171): a, c, t, g, unknown or other
  modified_base (303)..(303): a, c, t, g, unknown or other
  modified_base (403)..(403): a, c, t, g, unknown or other
  modified_base (413)..(413): a, c, t, g, unknown or other
  modified_base (424)..(424): a, c, t, g, unknown or other
  modified_base (444)..(444): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctnttaagaggtgtcatgtgtcaggtgcaattcgtggagtcgtgggggagcgtggccccaggtagggggtccctgagactctcctgtgcagcctctggacttcaccttgataattggaatatgccaggtggtccncaggctccgaggcggaggggctgggacgtggggtgcgaggtgtgtcatttcagtggaagtaatcaaagttctacggtaacgttccgtagacgggctatcncatcacaganacaatccgaanaactacagtgtactacttanaaactgaacacgtactagacgacctacgacggaccgacggtaccgttagttacgttttggacgtccgtaagtaccttagttaccgttacggtttaacctaaaacgttccggttactacgttaccgtacgtccggtacgggtaacccgg

SEQ ID NO: 425280 - DNA, 575 bp, Homo sapiens
  misc_feature: GZ8MTXP02I925D.44.27.C05.1.454.CMB.2.raw
  modified_base (187)..(187): a, c, t, g, unknown or other
  modified_base (221)..(221): a, c, t, g, unknown or other
  modified_base (263)..(263): a, c, t, g, unknown or other
  modified_base (275)..(275): a, c, t, g, unknown or other
  modified_base (293)..(293): a, c, t, g, unknown or other
  modified_base (300)..(300): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacaggtcctgggcccagtctgccctgactcagcctgcctcgtgtctgggtcncctggacagtcggtcaccatctcctgcactgganccagcggtaatattcttagtcttaacttgtctctgtatcacntcatcagtaacnccccaaatcatcatctangagctanaagcgtccctgtaggttactatcgtctcactcgacctcaacgtccgacaacgccgcctaccagacctatctcgtcgggcctcgaggtcgtaggacggacgacggtctaagtaatttattagttgttcgccttagagttattcggttcgtacgacctattcctagtttacgtcgttacgttacggaaggttaccgggacgtaaacggtcctaaccggtcgtacgtacacgtacccgaacgaccccgtaaacctctacgacctcgttccgttccccg

SEQ ID NO: 425281 - DNA, 626 bp, Homo sapiens
  misc_feature: GZ8MTXP02G02A0.44.27.C05.1.454.CMB.2.raw
  modified_base (276)..(276): a, c, t, g, unknown or other
  modified_base (279)..(279): a, c, t, g, unknown or other
  modified_base (297)..(297): a, c, t, g, unknown or other
  modified_base (309)..(309): a, c, t, g, unknown or other
  modified_base (311)..(311): a, c, t, g, unknown or other
  modified_base (333)..(333): a, c, t, g, unknown or other
  modified_base (340)..(340): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggtggagtcgtggggggaggcggtcggccccgaggtacggggggtccctggacgactctcctgtgcagcctntgnttcaccttgatatgaatntgcagtggtccncnggctcgaggcggaggggctggnggtgggnggcgaggtgtgtctatttcgagtggaaggtaaatcgaagtcgtaaggtgtacgtttccgtagggacgggtcctagttaccacctactccgtactagacgtaactaacgttaccgaagaaaccgacgacgttcgtccttacttaactaaatacgaacgtacgaccgtagaacgaccctagacggacgtacggtcgttagtttacgtttggcgacgtacgtacttactcgtttaagttaacccgtaaaagttccggtactacgtaccgaccggtcggtaacccggggg

SEQ ID NO: 425282 - DNA, 641 bp, Homo sapiens
  misc_feature: GZ8MTXP02IKWFP.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagactctcctgtgcagcctctggattcaccttcgataattggaatatgcaggtggtccgcaggctccgaggcgaggggctgggagtggggtgcgaggtgtgtctatttccagtggagaaatcgaagtctacgggtgtacttcccggttaggaccggggtcctaatttcccgaacctactcctaccgaacgaacgtaaactaaacgttaccgaaagaaacaacgagtcgttactacttaacaaaatagaacacgtacctagaacgacctacgaacggaccgtaccgggtccgttagtttacgttttagtggtacgtaagtaacttacgttacgttacgtttaaccgtaaaacgttcggttacttacgttaccgtaccgtaccggtacggggaacccgg

SEQ ID NO: 425283 - DNA, 696 bp, Homo sapiens
  misc_feature: GZ8MTXP02IX47Y.44.27.C05.1.454.CMB.2.raw
  modified_base (137)..(137): a, c, t, g, unknown or other
  modified_base (190)..(190): a, c, t, g, unknown or other
  modified_base (227)..(227): a, c, t, g, unknown or other
  modified_base (242)..(242): a, c, t, g, unknown or other
  modified_base (273)..(273): a, c, t, g, unknown or other
  modified_base (278)..(278): a, c, t, g, unknown or other
  modified_base (288)..(288): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacncagggtcctgggcccagtctgccctgactcagcctgcctccgtgtctgggtcncctggacagtcggtcaccatcctcctgcacgtggacnccaggtcgtaaattnttcttagttcttaattgtctctgtatcaacntcacncaggtaaacnccccaaatcatcatctagtgacgtactagtaacgacggccctagttagggtttactaagtcgtcttacacctcgtaccctacaagtcgaggaaccacgaccggtccctaccgtacgacctacgtctacgtcggacctacccgaggcgtacggaaggacggtacgtattaagtaattttacgttagtttcgggttctacctaggttaagttacgtttcgggtttaccgccgttaactaactttacgttaaccgtttaagttccgggtttacgttaaacggggtacggttaaccgggtaaacccgttacggtaccccggtaaccggtttacgtaaccggtaccgaacccggtaacccgaaaccggacccctaaaaccccttcggtacccttaaccggtacctttccccgg

SEQ ID NO: 425284 - DNA, 823 bp, Homo sapiens
  misc_feature: GZ8MTXP02GTVP5.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctgagactctcctgtgcagcctctggattcaccttcgataattggaatatgcaggtggtccgcaggcctccgaggcgaggggctgggaggtggggtggcgtagggtgtgtctatttccgagtggaaggtaaatcgaaaggttctacggggtgtaacgtttcccgggttagggaacgggggtcccgtaagttttcccgaaaccctaacgttacccgttacccgtaaacggggtaaaccggaaacccgtaaaacgtttacccccggggaaaacggtaaaacccaaacccgtaaagggttaccggtttacccgtttaacccgttttaacctaaaaacgtttacggtaaaacccgacgggtaaccccgttacgggaaaccggtaaccccgttaccggtaaacggggaacccggtaacccgggggtaccccggtttagggtttaaaccggtttttttggtacggtaccgggtaacggtaaaccggtttactttacggttaaccgttttaaaccgtaaaaacggtttccggtttaacgtaacggtttaccggaacccggtcccgggttaccgggggtaaccccgggg

SEQ ID NO: 425285 - DNA, 776 bp, Homo sapiens
  misc_feature: GZ8MTXP02HJ1Z6.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctggacgactcgtcctggtgctagcctctggattcaccgttcgattaagttggaatatgcaggtcggtccgcaggcctccgaggtccggaggggtctaggggacggtggggacggcgagggttgtgttccgtagttttcccgaagtaggggaaacgtaaagttccgaaaagggttccgttacgggggttcgtaaacggttttcccgggtagggaaacccgggggtcctaaagtttccccgaaacccgtaattcccgttaacccgaagtaacggtaaccctaaaacgttaccccggaaagttaaaacccgacgtaacggttacgttaccttaacccgtttaagaaaacgtttacgaaacgtacgtacccgtagaacccgtaccgtacggaacggtaaccgaccggttaccgtagttttaaccttttggggcgtaaccgaaggttaaccttacttacggtttaccgtttaaaacccgaaagtttccggtaacgttaacgttccggtaaccggtccgggtccggggttaaaccccggg

SEQ ID NO: 425286 - DNA, 689 bp, Homo sapiens
  misc_feature: GZ8MTXP02IW81T.44.27.C05.1.454.CMB.2.raw
  modified_base (306)..(306): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcgaggtgcaattcggtggagtcgtgggggagcgtggccccgaggtacgggggtccctgagactctcctgtgcagcctcgtggacttcaccttcgataatggaatatgcaggtggtccncaggctccgaggcggagggctgggaggtgggtggactagggtgtacgtactagtttccgagttgggaagtaaatcgaaggttcgtagggtgtacgttccgttaggacggggtacctattccgaacctagtccctaccgaagaacgaactaaacgttaccgaaagtaaccaacgtacgttcgtacttaccgttaacaaaagttacggaaacttaccggaccgtacggaaccgttaacccgtacggaaacggaaccgtaaccgggttcccggtttagtttaacggtttttgtacggaccgtaaaggttacttacgtttacttacggtttaaccaaaagtttccggtacttacgttaccggaccggtaccggtacgggtaacccgg

SEQ ID NO: 425287 - DNA, 732 bp, Homo sapiens
  misc_feature: GZ8MTXP02HPRRR.44.27.C05.1.454.CMB.2.raw
  modified_base (207)..(207): a, c, t, g, unknown or other
  modified_base (268)..(268): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcggnggagtcggtgggggaggcgtcggccccgagggtacgggggtccctggagctctcctgtgcngcctgtggatcacttgatagtgaatatgacaggtggtccgccgaggcctccgagggcggaggggcgtggggaggtggggtggcgtagggtggtgtactagtttacgagtagggaaggtaaatacggaagttcgtacgggttatacgtttcccggtaggtaccggggctacttcgacctactccgtaccgaaggtacgtaactaaccgttaccgaacgtaaccgtacgtacggttcttaccctttacttaaacgtaaaacgttaccggaaacgtaccgtacccgtaggtaacccgtaacccgtcggaaacggtacccggtaccggttacccggttttagtttaacgtttttcgggacgtaccggtaaacttaaccgttacgtttacccgtttaacggtttaaacccttaaaacggtttccggttacctacggtttacccggacccggtccggggttaacccgggg

SEQ ID NO: 425288 - DNA, 742 bp, Homo sapiens
  misc_feature: GZ8MTXP02G4ART.44.27.C05.1.454.CMB.2.raw
  modified_base (443)..(443): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcgaggtgctaagttcggtggaggtcggtggggggaggcggtcgggccccgagggtacggggggtccctggagacctctccgtgtgcagccctcgtggacttcaccttcgaattaagttggaatatgcgaggtcgggtcccgacgtaggcctcccggaagggccgggaggggcgtggggtacgggtggggtcggcgagggttgtgtacgtagtttaccgagtagggaaggtaaatcgtaaaggtcgttacgggtntacggtttcgggtaggacgggggtacctagttacccgactactactacgaaggtaacgaaactacgtacccgaaagaacctacgtaggtactttacctacctttaacgaaaacgtttacgaaacgtacgtaacccggttacgaaccgacccgttacggaaacgggtaccccggtaaacgggttcccggttaagttttacggtttttcgggtacgtaccggtaacgttaaccttaggttaccttacgtttaactaaaacggttcgtacgtacgttcggaccggtcggtacgggaacccgg

SEQ ID NO: 425289 - DNA, 723 bp, Homo sapiens
  misc_feature: GZ8MTXP02F4N9X.44.27.C05.1.454.CMB.2.raw
  modified_base (366)..(366): a, c, t, g, unknown or other
tcagacagtatatacacgaccggtgctcgatttagacgcgatcgaagggtttggggcctgggagacgagccccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacggggggtccctgagactctcctgtgcagcctctggacttcaccttcgataaagttggaatatgccgaggtcggtcccgccgaggcctccgagggcgaggggcgtgggaggtggggtaggcgaggtgtgtntatttccgagtggagaaatcgaacgttcgtacgggtgtaacttccggtagacggggtacgtacttccacctactccgtaccgagacgtaaacctaacgttacccggaagaaaaccgtacaaacggttcgttaccttacctttaacgaaaattacggtaaaccgacgtacccgtaacggaaccgtacccgtacggtaaccggaaccgtaacccggggttaccgttaggttttaaccgtttttaggcggtaccggtacgttaaccgttacgttaccgttacgtttaaacccgtaaaagtttcccggttaactaccggtttacccggaccggttaccccggtaccgggggtaaccccggg

SEQ ID NO: 425290 - DNA, 758 bp, Homo sapiens
  misc_feature: GZ8MTXP02JUO6C.44.27.C05.1.454.CMB.2.raw
  modified_base (177)..(177): a, c, t, g, unknown or other
tcagacagtatatacacgaccggtgctcgatttagacgcgatcgaagggtttggggctgggagacgagcccagcactggaagtcgccggtgcttccactcggtgatcatcactgaacacagaggactcaccatggagtttgggctgagcttgggttttcctcgttgccctcttaagnggtgtcatgtgtcaggtgcaattcgtggagtcgtgggggaggcgtggccccgagggtacgggggtccctggagactctcctggtcgcagtccctgtggtacttccaccttcgaattaagttggaaacttagtcgcgtaggttcgggtcccgccgaggcctacccgagggccggaggggtcgtggggagggtcgggggcagggtgtgtcgtagtttccgagtaggaagtaaactcgtaaagttccgtagggtgtacgtttccggtaggaccggggtacccttaacttcccaaccgtacgttccgtacccgaagtaaaccgtaaccgtaaacttcccggaaactaaaccgtacgtacgttacgttaccttaccgttaaacgtaaaagtaccgtaaaccgtaccggtaacccgtaggaacccgtaacccgtaccggaacggggtacccgtaaccggtcggtttaccgttttaaggtttttcggacggtacggtaacgttaacgttacgttacgtttaccgttaaacgtaaacgtttccgtaccgttacgttacccggaccggtcccgggttacgggaaccccgg

SEQ ID NO: 425291 - DNA, 715 bp, Homo sapiens
  misc_feature: GZ8MTXP02HXNBZ.44.27.C05.1.454.CMB.2.raw
  modified_base (290)..(290): a, c, t, g, unknown or other
  modified_base (303)..(303): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtacgggggtccctgagactctcctgtgcagcctctggacttcaccttgataagtgaatangcgagtcggtccncgaggctccgaggcggaggggctgggaggtgggtggcgtagggtgtcgtactagtttccgaagttagggaagtaaaactcgtaaaacggttcgttacggggttgttaacgtttcccgggttagggaacgggggtccctaatttacccgaaccctactccgtacccgaagtaacgaaaccgtaaacgttacccggaaacgtaaacgaacgtacgttacgtaccttacttaaacgtaaaacgttagaaaaccgtacgacccgtaggaaccgaccgtacgaacgtaaccgaacgggtccgttaggtttagtttacggacgtacgtaaacgtaacttacgtttaacgttactttaaacgtaaaacgtttcggttaactacgttaccggtaaccggtccggttacggggtaacccgg

SEQ ID NO: 425292 - DNA, 837 bp, Homo sapiens
  misc_feature: GZ8MTXP02H0BEI.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctctaagaggtgtcatgtgtcaggtgctaattcgttggagtcgtgggggaggcgtggccccgaggtacgggggtccctgagactctcctgtgcagcctctggacttccacttcgaattaagttaggaatagtgcgtaggtcgggtccccgcgacggctccgacggggcggaggggctgggacggtggggtggcgagggttgtggtctagtttccgagttacggggaaagtaaacgtcgtaaaaggttccgttacgggggtgttacgtttaccccggggttagggacggggggtccctaacgtttacccctaacccgtacttacccgtacccgaaaggtaaaccggtaaacccgtaaaaccgtttacccggaaaacggtaaacccaaaccggtaacggtttcggtttaccctttaccgtttaaacccgaaaatttaaccgggaaaacctaaccggacccgttaacggaaccggttaacccgtacggtaaccggggaaccgtaacccgggggttccggtttaacggtttttaacggtttttcggttaggtaccggtaacggttaaacctttacgttaccgttttaccggttttaaaccgtaaaacgtttcccggggtttaacttaccggtttaccggaacccggttcccgggttaccgggggtaacccccgg

SEQ ID NO: 425293 - DNA, 665 bp, Homo sapiens
  misc_feature: GZ8MTXP02JD97H.44.27.C05.1.454.CMB.2.raw
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcgtaatattcttagtcttaactttgtctctgtatacaacatcactccgaagtaaaccgacccccaaactcactcactctatgagacctagtaacgacgccctgtagggttctaatcgtcttcacctcgcctcaacgtccgacactaccggcctccacgactactctacgtcgggcctacgagtcgtaggaggaccgagggtctagttaatttattagtttcgtttagtcttagtaagtacgttcgtttccggaccgtactaaacgttccttaagttttacgtacggtttaccgtttacggggtaaaacgggttaccgggggtaacccttaaaccggggtacctaaccccggtttacttacgtaccgttaacccgaccggaacccccgtaaacggaccccctaaaccccggtacttaccggtaccctaccgtttccccg

SEQ ID NO: 425294 - DNA, 650 bp, Homo sapiens
  misc_feature: GZ8MTXP02JX516.44.27.C05.1.454.CMB.2.raw
  modified_base (303)..(303): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccagtagggggtccctgagactctctgtgcagcctctggattcgaccttcgataatggaatatgcagtggtccncaggctcgaggcgaggggctggagtgggtgcgaggtgtgtcatttcagtggaggaatgaagtctacgggtgtacttccgttagacggggtccgtaattccgactatcctaccgagacgacaacgttccgaaagtaaaccacgtacggtatccgttactttaccaaaagtacggaaacacgtacccgttagaacgtaccgtacgaacggtaccgaaaccggtcccgtttacggttaagtttttggacggtaccgtaaggttaccgtactttaccgttacggttttaacctaaaacggtttacggtttacctaacgttttaccggaaccggtcccggttaacccggggg

SEQ ID NO: 425295 - DNA, 694 bp, Homo sapiens
  misc_feature: GZ8MTXP02GJ4TS.44.27.C05.1.454.CMB.2.raw
  modified_base (300)..(300): a, c, t, g, unknown or other
  modified_base (387)..(387): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcacttcgataattggaatatgcagtggtccncaggcctcgaggcgaggggctgggagtggggtggcgtaggtgtgtctagtttcgagtgggaagaaagtcgaaagttcgtacggggtntacgtttccggttgacgggtcctagttcccacctactcctaccaaggagtaaaccgtaacgttacccgaagaaaccgtaacacgttacgttacttaccttaacgtaaaacgttcgaaacgtaacggccctaacggtaccgaacccgtacgaaacggaaccgtaaccggtccggtttacgttttaagtttttccggtagtaccggtaaacgtaacccgtttacgttaccgtttaacgtttaaccgtaaaacgtttccggttacttaaccgttccgggaaacccggttcccggttcgggggtaaccccg

SEQ ID NO: 425296 - DNA, 640 bp, Homo sapiens
  misc_feature: GZ8MTXP02GTMAP.44.27.C05.1.454.CMB.2.raw
  modified_base (189)..(189): a, c, t, g, unknown or other
  modified_base (224)..(224): a, c, t, g, unknown or other
  modified_base (237)..(237): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactggacnccgagcggtaatnttcttagtcttaactttgtctcctggtatcaacatcatccaaggtaaacaccccaaatcatcatctatgaggacctagtaagcggtccctgtagggtttctaagtcgtcttcacctcgcctacacgtccgacaacgccggcctacccgtgacactccgtaccggcgtacccacggcgtacgagggacgacgacgttacgtaagtttaatttagtttagttcggtactcctaggactttggttcgtaccgtcacgttacgtacttacgttacgttacgttacgggtaaacggttacgggtacggtaaaccgttacggtacccgtttaccgtaacggtacgtaccgacccgtaaccggaaccctaccccgtaactacgtccgtaacctccgttccgttacccccg

SEQ ID NO: 425297 - DNA, 602 bp, Homo sapiens
  misc_feature: GZ8MTXP02FW4Y5.44.27.C05.1.454.CMB.2.raw
  modified_base (190)..(190): a, c, t, g, unknown or other
  modified_base (224)..(224): a, c, t, g, unknown or other
  modified_base (235)..(235): a, c, t, g, unknown or other
  modified_base (252)..(252): a, c, t, g, unknown or other
  modified_base (261)..(261): a, c, t, g, unknown or other
  modified_base (267)..(267): a, c, t, g, unknown or other
  modified_base (312)..(312): a, c, t, g, unknown or other
  modified_base (387)..(387): a, c, t, g, unknown or other
  modified_base (454)..(454): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcactgganccagcgtaatnttcttagtcttaatttntctctggtntcaacntcatccaaggtaaacgcccccaaactcatcatctatgacgctaanaacgacgccctagtaggggtttctaactcgtcttcacctgcctacgaacgtccgacaaccgccgcctacccgtanacaacttctacgtcgggccttccgaggctaggacggacggtacgcttagtatttatttattgttacnctactaagtgttgttacgtcgtactatcttaacgtttatcgttacgtacggtaaggtcgggtaaccgaaggtccctaccggtaccgttacgggtaccaacggaccccgaaacggacccctaacccgacgtcgtctaccgtcttacccg

SEQ ID NO: 425298 - DNA, 549 bp, Homo sapiens
  misc_feature: GZ8MTXP02I6ZV1.44.27.C05.1.454.CMB.2.raw
  modified_base (306)..(306): a, c, t, g, unknown or other
  modified_base (380)..(380): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcgtgggttttcctcgttgccctcttaagaggtgtcatgtgtcaggtgcaattcgtggagtctgggggaggcgtggccccaggtaggggggtccctgagactctcctgtgcagcctctggattcaccttcgataattggaatatgcagtggtccnccaggctccgaggcgaggggctggagtgggtggcaggtgtgtcatttcattgaaggaatcaaagtcgtacggtnacttccgtgacgggcattcgacatctcagacgacaacttcgagaacacgagtcgtcttcttacaaattacgaacacgcctagacgtaccagacgacgacgcgtagtattttgcgtacgatactacttcgtacgttaactaaacgtcgttcagttcgacgtcgtacgggg

SEQ ID NO: 425299 - DNA, 538 bp, Homo sapiens
  misc_feature: GZ8MTXP02FHBJD.44.27.C05.1.454.CMB.2.raw
  modified_base (370)..(370): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaacttgtctcctggtatcaacatcatccaaggtaaacgccccaaactcatcatctatgaggcctaataagacggccctcgaggggtttctaatcgtcttcacctgcctcaacgtccggacaacncgccctcctgacaatctctgggctcaggctagaggacgagctagtattattattgttgctcagtatgttcgttcgccatcactttatgttcttacggaagtcgggaccaagggtccaaccgtctacggtcacgacccaaggcccaaacccgctcgtacactctacccg

SEQ ID NO: 425300 - DNA, 660 bp, Homo sapiens
  misc_feature: GZ8MTXP02GET56.44.27.C05.1.454.CMB.2.raw
  modified_base (325)..(325): a, c, t, g, unknown or other
  modified_base (659)..(659): a, c, t, g, unknown or other
tcagacagtatatacacgaccggtgctcgatttagacgcgatcgaagggtttgggggaggcgtggccccagtaggggggtccctgagactctcctgtgcagcctctggattcaccttcgataattggaatatgcagtgggtccgccaggctccaggcgaggggctggagtgggtggcaggtgtgtctatttcatggaagaaatcaagtctacggtgattccgttgaggccgattcaccatctccagagacaactcgaagacacagtgtctcttacaaatgaacagcctagacacctacgaggacgacggccgttgttagttttgngacgagtactattctcgtttaacctaaaagttccggtatacgttcccgtaccgtccgtcggggaccgacggtaacccgtggtccgtaccgttccgtcccgtcccgccctacccaccgtaaccggccctacgtcccggttccctcccccgtcggaccccgcccgtccgcccgaccgtaacggccgaccctaccccgtaccgaacggaccgaccgacgaccgggtcccggccccggtgggcctccggccgtcggtacgtaacggtaccttaccttacctaaagttacttaacgtcgtacgtcgacggtcgtcgtacgacgaacggccacgtacgang

SEQ ID NO: 425301 - DNA, 597 bp, Homo sapiens
  misc_feature: GZ8MTXP02FIHRU.44.27.C05.1.454.CMB.2.raw
  modified_base (187)..(187): a, c, t, g, unknown or other
  modified_base (219)..(219): a, c, t, g, unknown or other
  modified_base (231)..(231): a, c, t, g, unknown or other
  modified_base (380)..(380): a, c, t, g, unknown or other
  modified_base (465)..(465): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctggtcncctgacagtcgtcaccatctcctgcactgganccagcggtaatnttcttagtctttaacttgtctcctggtatcaacatcatccaacgtaaacgcccccaaactcatcatctatgacggcctaataacgacggtccctcgtaggggtttactaagtcgtcttcaccctcgcctcaacgtccgacacgccgccncctgacatctcgtgggctaccgacgtctagacggacgtacgctagtaacttattagttgtcgactaccagtacgtcgttcggtcnctactactacttactcgtacgttacgggtaacgtacgggtaaccgaaacggttccaacccgttaccgtacggtaccgaccggaacccgaacggaccccaaccccgtactacgtacctacctctttacccccg

SEQ ID NO: 425302 - DNA, 770 bp, Homo sapiens
  misc_feature: GZ8MTXP02GBYFA.44.27.C05.1.454.CMB.2.raw
  modified_base (267)..(267): a, c, t, g, unknown or other
  modified_base (304)..(304): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtcggccccgagggtacgggggtccctgacgactctcctgtgcagcctntggattcacttgataattggaatatgcaggtggtccnccagcctccgaggcgaggggctgggagtggggtgcgtaggtgtgtctatttccgagtcgggaaggaaactcgaaagttcgtacggggtgaacgtttccggttagaaccggggtcctaagtttaccaacccgtatccctaccgaaggaacgtaaaccgtaaaacgttaccccgaaagaaaacccgacgtaacgttacggttaccctttacctttaaaccgtaaaagttaccggtaaaaaccgaacggttacccccgtaaggaaaccggtaacccccgttacggaaaaccgggacccggtaaacccggggtcccggtttacggttttacggttttttaccggagggttacccggtaaggttaactttaacgtttaccgtttacgttttaaaacccgtaaaaacggtttcccgggttaacttaccgtttaccggaacccgggtcccggttacgggggtaaacccccggg

SEQ ID NO: 425303 - DNA, 610 bp, Homo sapiens
  misc_feature: GZ8MTXP02GEOPJ.44.27.C05.1.454.CMB.2.raw
  modified_base (332)..(332): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctctggattcaccttcgataattggaatatgcagtggtccgcaggctcgaggcgaggggctgggagtggggnggcgaggtgtgtctatttcagtggagaaatcgaaagtcgtacgggtgagttccggttagacggggtccgtattccgacctactcctcctaacgacgaactaaactaccgaagaaccacgacgtcgtactacttactaaactacgaacacgaccacgtacgacctacgaacggacgaaccggtcgtagttacgttttaggtcgtacgacgtacttaacttcttacggtttacctaaaagttccgttactacgttacgaccggtccgtacgggtacccgg

SEQ ID NO: 425304 - DNA, 738 bp, Homo sapiens
  misc_feature: GZ8MTXP02JHRKJ.44.27.C05.1.454.CMB.2.raw
  modified_base (214)..(214): a, c, t, g, unknown or other
  modified_base (222)..(222): a, c, t, g, unknown or other
  modified_base (233)..(233): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcgtcaccatcctccngcactganccagcgtaatnttcttagtcttaacttgtctccgtggtatcaacatcatccaaggtaaaccgcccccaaatcatcatctatgaggtccctaagtaacgacggtcccccttaggtaacggggttttactaaacgttcgtactttacgaaccctcgtacccttaccgaaacgggttccccggacctaaaccgacccggggtaccccctcccgttacggaaaccctaagttcccgtttacgtccggggtaccctcccggtaaacggtccgtacgggaacgggtaaacccggtgggtacccttaagtaacgtttttaatttaacgttttgttcgttacctacgtaagttagttcgggttccgtacgtactacgttactaaacctttgttcgttaacggtttagggaacggtttcgggaaacccaaagggttccctaacgggttaccgtttaccggggaacccgccgaaacccgaacccggacccctaacccgtacgtccgtacctccgttccgttacccg

SEQ ID NO: 425305 - DNA, 796 bp, Homo sapiens
  misc_feature: GZ8MTXP02HZFD3.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaagttcgtggagtcggtgggggaggcggtggccccgaggtacggggggtccctggacgtactcgtcctggtgcgacgcctcgtggacttcaccttcggaattaagtggaatatgacgagtggtcccgcaggcctaccgaggcggacggggcgttaggggaggttggggtggacggtaggggttggtcgtcctagtttttacgagttaggggaaaggtaaattccgaaaggttccgttaacgggtagtaacgtttcccggggtttagaaccggggtccgtaacgttaccctaacccgtaacgttcccttaacccgaaggtaacgaaaccctaaacgtttaacccggaaacgaaacccgttaccgaagggttcgttacccgttaccgtttaaactaaaacgttaacggaaccgtaacggacccgttacgggaacggttaacccctacgggaaccggtaacccggaccgggtccccggtttaggttttaacgttttttcggcggtaccggtaacggtaccgttaacttaccgtttacgtttaacctaaaacggtttcggttaccgtaacgtttaccggacccggtaccggtcccggggg

SEQ ID NO: 425306 - DNA, 744 bp, Homo sapiens
  misc_feature: GZ8MTXP02HNVV3.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggagcgtggccccgaggtacgggggtccctgagactctcctgtgcagcctctggtatcaccttcgattaataggaatatgacgtaggtcgggtccgccaggcctaccgagggcggaggggcgtgggaggtggggtggcgtaggttgtgtactagttccagtaggaagtaaagtcgtaaagtcgtacgggtcgtaacgtttccggttagggacggggtccctaattacccgaacccgtactcccgtaccgaagtaacgaacgtaaacgttacccggaacgtaaacccaacgtacgttacgttacctttactttaaccgaaaacgttaacgtaaaccgtaaccggtacccgtacggaaccgtaccctaccggaacgggaccgtaacccgggtaccggtttacgttttaacggtttttcggttacggtaccggtaagttaacccgtttattacccgtttacgtttaaccgtaaaacgtttcggttaacttacggttaccggtaccggtacccgggttacgggaaccccggg

SEQ ID NO: 425307 - DNA, 765 bp, Homo sapiens
  misc_feature: GZ8MTXP02FPXUH.44.27.C05.1.454.CMB.2.raw
  modified_base (263)..(263): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctntggattcaccttcgataattggaatatgcagtcgggtccgccgtaggctccgaggccggaggggctgggaggtggggtggcgagggtgtgtctagtttccgagttgggaaggtaaaactcgtaaacggttcgttaccggggtggtaacgtttcccgggttgggtaaccgggggtcccggtaaactttcccgaacccgtaacgttccctacccgaaggtaacgtaaacgtaaacgttacccggaaaagaaaccctaaccgtaaacggttcgtttacctttaccgtttaaccaaaacgttacggtaaaaccgaccggtaccccgttaggaaccggtacccctacggaaacggaaccggtaacccggggtccggtttacggtttaacgtttttcggtaggtaccggtaaaggtaccttaacgtttccgttaacgtttaaccgtaaaagtttccggttacgttacgtttaccggaaccggtcccgggttacggggtaacccccggg

SEQ ID NO: 425308 - DNA, 714 bp, Homo sapiens
  misc_feature: GZ8MTXP02FPRY9.44.27.C05.1.454.CMB.2.raw
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctgtggattcaccttgataaattggaatagtgcgtaggtcgggtcccgccgaggcctccggagggcggaggggctgggaggtggggtggcgtaggtgtgtctagtttccgagtagggaagtaaactcgaaacggttcgtacggggtgtaacgtttccggtaggacggggtccgtaaagttccaacccgtactcccgtaccgaagtacggtaacctaacgttacccgaaagtaaaccctactacgtcttaccttacttacgtaaaatcgaaacacggtaccttaggaacctacccgtacgaacggaccgtaccgggttccgttagtttacgtttttcggacggttaccgtaacgtacgtttaacgtttaccgttaacggttttaaaccctaaaaggtttccggttaacgttaccgttacccggtaccggtacccgggtacgggggtaaccccgg

SEQ ID NO: 425309 - DNA, 693 bp, Homo sapiens
  misc_feature: GZ8MTXP02GN29B.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccaggtacgggggtccctgacgactctcctgtcgcacgcctctggtacttccaccttacgtaataagttaggaatagtgcgaggtcgggtcccgccgacggcctccgaggcggaggggcgtagggtacggtggggtgcggaggtgtgtctaaaaagttccgaagtaggaagtaactacgtaagttacgtacggttagtacgttccggttaggaccgggtacgtacttaccgaccctagtaccgtacccgagtaacgaactaacgttaccgaacgtaaccacgtacgttacgttaccttacttaactaaacgttacgaaccgacgtcctacgacgaccgtacgaacggaccgtaccggtccgttagtttacgtttacgacggtacgtacgtacttacgttaccgttacgtttaactaaacgttaccgttacgttacgttcgtacccggtaccggtacgggtaacccgg

SEQ ID NO: 425310 - DNA, 627 bp, Homo sapiens
  misc_feature: GZ8MTXP02GPJDG.44.27.C05.1.454.CMB.2.raw
  modified_base (198)..(198): a, c, t, g, unknown or other
  modified_base (262)..(262): a, c, t, g, unknown or other
  modified_base (272)..(272): a, c, t, g, unknown or other
  modified_base (291)..(291): a, c, t, g, unknown or other
  modified_base (304)..(304): a, c, t, g, unknown or other
  modified_base (390)..(390): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagttgggctgagctgggttttcctcgttcgccctcttaagaggtgtcatgtgtcaggtnctaattcggtggagtcgtgggggagcggtcggccccgaggtacgggggtcctgagctctcctgngcagctctgnttcactcgataattgaatntgcagtcggtccncgagctccgaggcgagggctgggaggtggggtggcgtaggtgtacggtctagtttcagtaggaacggtaaatcgaaatgtacggtntacgttcgtgacggcgtatcacactctacgagacgaacaactacgaagaaacacgagtctacctagttaactaaaatacgaaacacgacccgttagaaccgtaccacgaacggaaccgacggtacgttagttaagttttgtaccgtagtacgtaccttaaacgtctttaacgtttaaaccgtaaaacgtttacggttaacctacgtttaccggtaccggtacccggttaaccggggg

SEQ ID NO: 425311 - DNA, 535 bp, Homo sapiens
  misc_feature: GZ8MTXP02JT019.44.27.C05.1.454.CMB.2.raw
  modified_base (298)..(298): a, c, t, g, unknown or other
  modified_base (406)..(406): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccagtaggggggtccctgagactctcctgtgcagcctctggattcaccttcgataatggaatatgcagtggtccnccaggctccgaggcgaggggctggagtgggtggcaggtgtgtcatttccagtggagaaatcaagtctcggtgattccgttgagggcccgattccacactctccagtanacgaattccgagaaccacagtgtactacttacaaatagaaacagacctagacgactcgagacacgccgtgtatttgtgtcgagactatctagtttcaaaagtcgttacacttcgacgccgtgggacccg

SEQ ID NO: 425312 - DNA, 671 bp, Homo sapiens
  misc_feature: GZ8MTXP02HAOTC.44.27.C05.1.454.CMB.2.raw
  modified_base (189)..(189): a, c, t, g, unknown or other
  modified_base (221)..(221): a, c, t, g, unknown or other
  modified_base (232)..(232): a, c, t, g, unknown or other
  modified_base (259)..(259): a, c, t, g, unknown or other
  modified_base (521)..(521): a, c, t, g, unknown or other
  modified_base (539)..(539): a, c, t, g, unknown or other
  modified_base (546)..(546): a, c, t, g, unknown or other
tcagacagtatatacacgaccggtgctcgatttagacgcgatcgaagggtttgggggggtcacaagaggcagcgctctcgggacgtctccaccatggccctgggctctgctgctcctcactctcctcaccaggacacagggtcctgggcccagtctgccctgactcagcctgcctccgtgtctgggtcncctgacagtcgtcaccatctcctgcactgganccagcgtaatnttctagtcttaattgctctgtatcaanatcataccaacgtaaacgaccccaaactcaatctatctaatgacgtacctaaagtaaggacgtacccttacggtaagggtttacctaaacgtcgtccttacgtaaccctcgtaccccttacgaaacggttccgaaccaaccgacccggtacccttacccgacggtaaactaaacgttccgttaacgtcgggtccttacccgaggtaccgtacgggaacggacgtaacggcgtagttaagttagttagtttgttacgacttanaagttgtcttacggtacncttaacncttaacgtttatacggttacgttaacgtaacgggtacgtaacggtaacgtaccgtaccgttaacgtacgtcgaaccgacccgaaccgtacccaaaccgtactcggtacctaaccttccgttcccg

SEQ ID NO: 425313 - DNA, 597 bp, Homo sapiens
  misc_feature: GZ8MTXP02GBG6D.44.27.C05.1.454.CMB.2.raw
  modified_base (265)..(265): a, c, t, g, unknown or other
  modified_base (300)..(300): a, c, t, g, unknown or other
  modified_base (340)..(340): a, c, t, g, unknown or other
  modified_base (388)..(388): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtagggggtccctggagactctcctgtgcagcctntggattcacttgataattggatatgcagtggtccncaggctcgaggcgaggggctgggagtggggtgctagggtntgtctatttcccgagtgggaagaaactcgaaacggttcgtacggggtnaagttccgtggacgggtccgtattccactatcctaccagaagactaactccgaagaacacagtcgttactactacaaacgtcgaaactacgactacgacgtaccacgaacggaccgacggtccgtagttacgttttagcggagtacgtactacttcttagttaacctaaaagttcggttactacgttccggaacgccgtacgggacccg

SEQ ID NO: 425314 - DNA, 598 bp, Homo sapiens
  misc_feature: GZ8MTXP02IXCQN.44.27.C05.1.454.CMB.2.raw
  modified_base (268)..(268): a, c, t, g, unknown or other
  modified_base (308)..(308): a, c, t, g, unknown or other
  modified_base (388)..(388): a, c, t, g, unknown or other
  modified_base (409)..(409): a, c, t, g, unknown or other
  modified_base (412)..(412): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggccccgaggtagggggtccctgagactctcctgtgcagcctntggacttcaccttcgataatggaatatgctagtcggtccnccgaggcctccgaggccggagggctggagtgggtgcgaggtgtgtctatttcgagtggaaagtaatcgaagtcgtaggtnagttcgtgacggctatcactntcncagagactactacgaagaacacgagtgtctactaacaatagaacacgtccgtacgacgaccgtacgacgtacgacggtccgttagttagtttttacggacgtacgtacgtactacgtctttaaccgttaaccgttaaaacgttccggtttacgtacgttaccggtacggtacccggtaaccggggg

SEQ ID NO: 425315 - DNA, 599 bp, Homo sapiens
  misc_feature: GZ8MTXP02IDHK5.44.27.C05.1.454.CMB.2.raw
  modified_base (386)..(386): a, c, t, g, unknown or other
  modified_base (442)..(442): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtcctgagactctcctgtgcagcctctggattcaccttcgataatggaatatgcagtggtccgccaggcctccgaggccggaggggctgggaggtggggtggcgaggtgtgtctatttcgatggaaggaaatcaagttcgtacggtntagtttcccgtggacgggggccattccaccgtatcctaccagagacaattccgaanaacacagtagtctacttacaaatgaacaacgtcctagacgacctcgaaggaccgacgggtccgttaggtttacttttggtcgacgtagtactaacgttccttagtttaacccgaaaagttcggttactacgttaccggtaaccgtcggtaccggggg

SEQ ID NO: 425316 - DNA, 688 bp, Homo sapiens
  misc_feature: GZ8MTXP02IY5F1.44.27.C05.1.454.CMB.2.raw
  modified_base (397)..(397): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtccctgagacctctcctgtgcagcctctggattcaccttcgattaattggaatatgacagtgggtccgcgaggctccgaggcgagggctggagtgggtggcgaggtgtggtactatttcccgagttggaaggaaaactcgaaaggttctacgggggttntacgtttccggtagacggggtacctacttaccaacctactacctaccaaggaacgaaacgtaaacgttaccgaaacgaaaccgtacgtacgttcgttacttacttaaactaaaacgtacgaaacgacgtaccgtacgacgaaccgtacggaacggaccgtaacgggtacgtttacgtttacggttttaggacggtacgtaacgttacgtttacgttacgtttaaacgtttaaaccgtaaaacgtttacgttacgttacgttaccggtaccggtaccggtacggggtaaccg

SEQ ID NO: 425317 - DNA, 634 bp, Homo sapiens
  misc_feature: GZ8MTXP02FIHK9.44.27.C05.1.454.CMB.2.raw
  modified_base (396)..(396): a, c, t, g, unknown or other
  modified_base (506)..(506): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacggggggtcccctggagacctctcctgtgcagcctctggacttcaccttcgataattggaatatgcagtggccgccaggcctccgaggcggaggggctgggagtggggtggcgagggtgtgtctactttcatggaaggaaatcgaagtcctacgggtntagtttcccggttgacggggacccgtatttccaccctactcctacccgagaacgaccaaatttacccggaaacgaaacaccagttcgtcctacttacaaagtgaaaaccncgaccgtacgaacgacctacgacggaccgaccggtcgttacgtttagtttcgtcgacgtacgtactacttacttacgttaaccgtaaacgttaccggttactacgttccggaccggtccggtccgggg

SEQ ID NO: 425318 - DNA, 739 bp, Homo sapiens
  misc_feature: GZ8MTXP02FOTKT.44.27.C05.1.454.CMB.2.raw
  modified_base (267)..(267): a, c, t, g, unknown or other
  modified_base (341)..(341): a, c, t, g, unknown or other
tcagacagtatatacacgaccggtgctcgatttagacgcgatcgaagggtttggggcctgggagacgagcccagcactggaagtcgcccggtgtttcccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgcagcctcnggattcacttcgataattggaatatgcgagtcgggtccaccgaggcctcgaggcggagggctgggacgtggggngcgagggtgtgtcatttcccagtggagaaatcaagttctacggtgagtttccggttgacgggtccgtaattccaaccctatacccgttaccgaaggaacgtaacgtaacgttacccggaaagaaaccgtacgtaaacgttcggttaacttaccctttaaacgaaaagttacggaaaaccgacggtaccccgtttaacggtaaccggaacccccgtttacgtaaacggggaacccgttaaccccgggggtcccgtttagggtttaaactttttttcgggagttaccgggtaacgttaactttacgttaccgtttaacggttttaacccctaaaaagtttacccgggttacttaacgtttaccggtaaacccggtcccggttacgggggtaaacccccgg

SEQ ID NO: 425319 - DNA, 706 bp, Homo sapiens
  misc_feature: GZ8MTXP02F5VQD.44.27.C05.1.454.CMB.2.raw
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacggggggtccctggagacctctcctgtgcacgcctcgtggtacttcgaccttcgattaagttggaatagtgcaggtcggtccgcacggctccgaggcggagggcgtggacggtgggtgcgtaggtgtgtctagtttcagtgggaagaaatcgtaaagtcgtacgggtgtaacgtttccggttaggacggggtccgtatttacccgaaccctattaccgtacccgtaaggaacgtaaacccgtaaacgttacccggaaacggtaaaccctaacgtaacgttccggttaacctttacgttaaaccaaaagtttaccggaaactaacggtacctaacgtaccgtaaccgttacggaaacggaccgtaaccgggtccgtttagtttacgttttggacgtcgtaaacgtacttacgttcgttacgtttaaacaaacgtttccggtatacgttcgaaccgtcgggtacggtacccgg

SEQ ID NO: 425320 - DNA, 651 bp, Homo sapiens
  misc_feature: GZ8MTXP02I8I7Y.44.27.C05.1.454.CMB.2.raw
  modified_base (191)..(191): a, c, t, g, unknown or other
  modified_base (228)..(228): a, c, t, g, unknown or other
  modified_base (240)..(240): a, c, t, g, unknown or other
  modified_base (275)..(275): a, c, t, g, unknown or other
  modified_base (300)..(300): a, c, t, g, unknown or other
  modified_base (303)..(303): a, c, t, g, unknown or other
  modified_base (310)..(310): a, c, t, g, unknown or other
  modified_base (406)..(406): a, c, t, g, unknown or other
  modified_base (440)..(440): a, c, t, g, unknown or other
  modified_base (479)..(479): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcggtcaccatcctcctgcacgtggacnccagcggtaatnttcttagtcttaacgtttgcctcgtgtactcaacntcatcaaggtaaacgccccctaaancancatctangaacggcctaagtaagacgtccctaggtagggtttactaacgtcgtctcacccgtcgtacctacgacgtccgaccaaccgtccggtccctccgtanaacctacgtcgtcgtacgggtcctcggtacgcgnggtaacggagacggtctagttacttatttacgttgtacncgttacgagttacgttcgttcgtaccgtctacttcgtaactttgtacgttcgttacgggtaacgtacgggtaaccgtacggtccgtaaacggttcccgtaacgggtcaacccggtacccggaaaacgtcccctaaaacccgtcgtaccgtacctaccgttaccgtttacccg

SEQ ID NO: 425321 - DNA, 772 bp, Homo sapiens
  misc_feature: GZ8MTXP02GPR57.44.27.C05.1.454.CMB.2.raw
  modified_base (302)..(302): a, c, t, g, unknown or other
  modified_base (321)..(321): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagagtgtcatgtgtcaggtgcaattcgtggagtcgtgggggagcgtggcccgaggtacgggggtccctgacgactctcctgtgcagtcctcgtggtacttcctaccttacgattaaagttggaattagngtacgaggtcggggtcccnccgacggtcctccggaggacggaggggcctggggtaggtggggtcggcgtaggttggtcgtacgtacgttttccgaggtacgggaagtaaactcgtaaacggttcgttacgggttcgtaacgttttccgggttaggtacggggtacccgttaacgtttcccgaaacccttacgtacccgttacccgaaggtaaacgttaaacccgaaacgtttaccccgggaaataaaccggtaacgtacgtttcgttaacccgtttacgttaaaccaaaagttacggaaacctacggtaccgtacgaaccttaccgacgtaacggtaccgacgggtacctttggtttaacgttttggagttaccggtataacctttacgtttaccgtacttttaaacccgaaaggtttccggttaactacgttttaccggacccgtccgggtaacggggttaacccccgg

SEQ ID NO: 425322 - DNA, 729 bp, Homo sapiens
  misc_feature: GZ8MTXP02GSWWO.44.27.C05.1.454.CMB.2.raw
  modified_base (191)..(191): a, c, t, g, unknown or other
  modified_base (209)..(209): a, c, t, g, unknown or other
  modified_base (216)..(216): a, c, t, g, unknown or other
  modified_base (226)..(226): a, c, t, g, unknown or other
  modified_base (238)..(238): a, c, t, g, unknown or other
  modified_base (254)..(254): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcncctggacagtcggtcacntcctccngcagtggacnccagcgtaattnttcttagtcttacttnctccgtggtactcaactatcataccgaaggtaaaccacccccaaaactcactacatctaagtggaacggtacctaagtaacgaccggtcccttaggtaacggggttttacctaaagttccgtccttactaccccgtcgtcccctaccacggtacccggaccaaaccggtcccgggtccccttacccgtacggaacctaacgttcccgtcgtaccggggtccctacccggaggttccgtagggaacgggtaaccgggtacggtccgttaggttaaacttttagttacgtttgttacggtaccttagtagttcgtttacgttcggtactactactaccgttactttagttcggttacgttacggacggttacggaacccgtacggtacccgtaccggttacgttacggtacccgaacgaccctaaacccggacccctaacccttacgtacccgttcctaaaccttccgtttcccccg

SEQ ID NO: 425323 - DNA, 661 bp, Homo sapiens
  misc_feature: GZ8MTXP02G6CSH.44.27.C05.1.454.CMB.2.raw
  modified_base (189)..(189): a, c, t, g, unknown or other
  modified_base (207)..(207): a, c, t, g, unknown or other
  modified_base (222)..(222): a, c, t, g, unknown or other
  modified_base (233)..(233): a, c, t, g, unknown or other
  modified_base (261)..(261): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcgtcaccntctcctgcactgganccagcgtaatnttcttagtcttaattgtctctgtatcantcatcaagtaacaccccaaatcatcatctatgacgtacctaagtaacgacggtaccctaggtacgggtttactaacgtccgtacttacgaccctcgtcctaccaacggtcccgaccaacgccggtccctccgtacgacctacttcgtcgtcgggcctcgacggtacgtacgggaggacgtacgtctagttacgtttattacgttgttacggacttacggtaagttcgttcggttccgtaccgtactaacgttcttaaacgtttgtccggtttacggtacggtaacgggtaccgggtaaccgtaaggttacccgtacgttaccggtacgtacccgaacccggtaacccgaaccggccccctaaaaccccgtgttacccgtacctaccgtccgtttcccccg

SEQ ID NO: 425324 - DNA, 649 bp, Homo sapiens
  misc_feature: GZ8MTXP02IEFLV.44.27.C05.1.454.CMB.2.raw
  modified_base (177)..(177): a, c, t, g, unknown or other
  modified_base (456)..(456): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagnggtgtcatgtgtcaggtgcaattcgtggagtcgtgggggaggcgtggccccgaggtacggggggtccctggagactctcctgtgcagccctctggacttccacttcgaattaatggaatatgcgaggtgggtaccccgccaggcctccgagggccggaggggctggggaggtcggggtaggcgtagggtgtggtctatttccgagttgggaaacggtaaatcgtaaaggttctacggggtgtagttcccggttgacgggggtcctatcccgaacctacnctccgacgacgaactaacgttaccgaacgaacactagtcgtactacttacaaatacgaaacacgtcctacgaaccgacctcgaacggaccgtaccgggtccgttagtttacgttttggtagtcgtacgtaacttctacgtttacgttaactaaacgttcgtactacgtcggtaccgtcggtacgggtacccgg

SEQ ID NO: 425325 - DNA, 652 bp, Homo sapiens
  misc_feature: GZ8MTXP02HRKLU.44.27.C05.1.454.CMB.2.raw
  modified_base (261)..(261): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggagcgtggcccctaggtacgggggtccctgagtactctcctgtgcngcctgtggattcacttcgataatggaactatgacaggtcggtccgcgaggcctccgaggcggaggggctggggagtggggtggcgtagggtcgttgtctagtttaccgagttacggaaggtaaatcgtaaacggttacgttacggggtacgttacttccggttagggacgggtccgtattaccaccgtactcgtacaacgagtaacctaacgtaccgaagaactacgacgtgttacttacttacaaacttagacacgactacgacgacacgacggacgaccggtacgttagtttacttttaggtagtacgtaacgttactacgttactttacgttaaacgtaaaacgttcggttaacttacgttaccgacgtaccggtacgggtaacccgg

SEQ ID NO: 425326 - DNA, 631 bp, Homo sapiens
  misc_feature: GZ8MTXP02HGD9K.44.27.C05.1.454.CMB.2.raw
  modified_base (186)..(186): a, c, t, g, unknown or other
  modified_base (219)..(219): a, c, t, g, unknown or other
  modified_base (273)..(273): a, c, t, g, unknown or other
tcagacagtatatacacgaccggtgctcgatttagacgcgatcgaagggtttgggggggtcacaagaggcagcgctctcgggactctccaccatggcctgggctctgctgctcctcactctcctcaccaggacacagggtcctgggcccagtctgcctgactcagcctgcctccgtgtctgggtcncctggacagtcgtcaccatcctctgcactggancagcgtaatattctagtcttaacttgctctggtatcaacatcatcaggtaaacnccccaaatcaatcatcgtatgagctataagcgcctcgaggttcaatcgcttcaccttcgacctcaagtccggacaacgaccgccttaccgcgaacctaatctctcgggcctaccgaggccttagggacgggaaccgtaaggccgtacggtaacgttaatttaaagtttacggtttaggtcctacgtaacgttaaacgttagttacggttcggtaccgaagtaccgtaacccgttaacttagttcgtttacggaacggttacgggaaccggtaacggtaccgtaccgtaccgttacgtacgtacgaccgaaccggacccgtaaccccgacctacggtacctaaccttacctttaccccg

SEQ ID NO: 425327 - DNA, 667 bp, Homo sapiens
  misc_feature: GZ8MTXP02F57CF.44.27.C05.1.454.CMB.2.raw
  modified_base (340)..(340): a, c, t, g, unknown or other
  modified_base (505)..(505): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagcttgggttttcctcgttgccctcgttaagaggtgtcatgtgtcaggtgcaattcgtggagtcgtgggggagcgtcggcccaggtagggggtccctgacgactctctgtgcacgcctgtgattcaccttgataattggaatagtgacgaggtcggtcccgcgacggtctcccgagggcggaggggcgtagggnggtgggtgcgtaggtgtagtctagtttccgagtgggaaacgtaactcgaacgttcgtacggtgtacgtttcggttaggaccggtctacttcaccgtatcctaccgaagaacgaactaacgttaccgaaacgtaccgaacgtacgttcgttacctaccgttaaaanaaacgtacgtaacgtacgtaccgtacgaaccgtaccgacggaacggtaaccgtccggtcgtttacgtttacggtttcggagtacgtacgttacgttacgttacgttaacgttaaaccgtaacgttcgttacgtacgtaccgaccggtaccggtacggacccg

SEQ ID NO: 425328 - DNA, 719 bp, Homo sapiens
  misc_feature: GZ8MTXP02GIQNJ.44.27.C05.1.454.CMB.2.raw
  modified_base (300)..(300): a, c, t, g, unknown or other
  modified_base (304)..(304): a, c, t, g, unknown or other
  modified_base (313)..(313): a, c, t, g, unknown or other
  modified_base (346)..(346): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggtcggtggcccccgagggtacggggggtccctggagaccttcgtcctgtgcagcctcgtggacttcaccttgataatggaatntgcngtggtcccncaggctccgaggcggaggggctgggagtggggnggcgtaggtgtgtactgttccagtggaaagaactacaacgttcgtacggtgtacgttccggttggaccggggtactacgttaccaccgtagttacccgtaccgaaacggtaagaacctaaacgttacccggaaacggaaaccctaacgtacgttgttacccttaacgtttaaaccaaagttaacgaacctaacggtcccttaaacggaaccgtaccgtacccgaaacggggaccgtaccggtacccgggtttattttaacggtttcggttagaccgggttaactaacgttacttaccggtttacgttaaacccctaaaagtttccggtaccgttacgtacccggttacggcccggttacggggtaaaccccgg

SEQ ID NO: 425329 - DNA, 637 bp, Homo sapiens
  misc_feature: GZ8MTXP02IUGIS.44.27.C05.1.454.CMB.2.raw
  modified_base (204)..(204): a, c, t, g, unknown or other
  modified_base (307)..(307): a, c, t, g, unknown or other
  modified_base (395)..(395): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttccctcgttgccctcttaagaggtgtcatgtgtcaggtgcaattcgnggagtcgtgggggaggcgtggccccaggtacggggggtccctgagactctcctgtgcagcctctggattcaccttcgataatggaatatgcaggtcggtcccncaggcctccgagggccgaggggctgggaggtggggtggcagggtgtgtctagtttccgagtgggaagtaaatcaaagttctcggggtntagttccggttgacggggctattccactacgtcctcgagaagaacacttaccgaacgaaccacgtagtcgtacttcttacaaagtagaacacgacctagacgtaccacgacggacgtaaccggcgtagtttacgttttgtcggtacgtaacgtacgttacgttaccttacggtttaaccctaaaacgtttccggttaacctacgtttacccggaaccggtcccggtacggggtaaccccggg

SEQ ID NO: 425330 - DNA, 627 bp, Homo sapiens
  misc_feature: GZ8MTXP02FPWRC.44.27.C05.1.454.CMB.2.raw
  modified_base (446)..(446): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctgagactctcctgtgtagcctctggattcaccttcgataattggaatatgcaggtggtccgcaggctccaggcgaggggctgggaggtgggtggcaggtgtgtctatttcgatggaggaaatcgaagtcgtacggtgactttccggtagacggggccgtattcaccatcctccagacgaacaagttcccgaagaacacagtcgtctcttacaaatgaacngacctagacgacctagacggacacggtaccgtagttactttgtcgcgtacactatcgttacgtttaccaaaagttccggtttactaacgtttaccgaccgtccggtacgggggtacccgtaacggggtaacccccgttacggttacccgtacccggtttcctaccccggtcggtacccccg

SEQ ID NO: 425331 - DNA, 652 bp, Homo sapiens
  misc_feature: GZ8MTXP02FRTVS.44.27.C05.1.454.CMB.2.raw
  modified_base (270)..(270): a, c, t, g, unknown or other
  modified_base (400)..(400): a, c, t, g, unknown or other
  modified_base (428)..(428): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaattcgtggagtcgtgggggaggcggtggccccgaggtaggggggtccctggagactctcctgtgcagcctntggattcaccttgataattggaatatgcaggtcgggtccgccaggcctccgagggcggaggggctggggaggtggggtggcgagggtgtgtctatttgagtagggaagtaaactgaaagttcgtcgggtntacgtttccgtgacggggcctatccacntcctcagacatactccaagacacagtgtctactacaaatgaaccagacctacgaacgtacctacgaacggaccgtaaccgggtaccggtttacggtttagttttttacggcggttacggtaacggttaaacgttactttaccgtttaacgttttaaacccgtaaaagtttccggtttactacggttaccggtaacccggcccggtttacggggtaacccccggg

SEQ ID NO: 425332 - DNA, 638 bp, Homo sapiens
  misc_feature: GZ8MTXP02HFNOD.44.27.C05.1.454.CMB.2.raw
  modified_base (226)..(226): a, c, t, g, unknown or other
  modified_base (267)..(267): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacaggtcggtcaccatctcctgcactgganccagcgtaatattctagtctttaattgtctctgtatcaacntcatccaaggtaacacccccaaatcatcatctatgacgacctagtaacgacggccctacgtagggttctaatcgcttcacctcgcctcaacgtccgacaacgccggtcctcctagactaactcctacgtcgggcctccgacggtccgtagggaggaacggacgtctagttaatttagttagttgttcggtacttacgagttagttcggttccggtactcctaattctaacgtttattcggttaccgtttaggggaacggttacggtaaccgtaacggttacccgtaccggttaccggtagggtacctagtttccggtaacgtaacccgttagaaacggttaaaacgtcggtaaacggaagggtaaaggggg

SEQ ID NO: 425333 - DNA, 559 bp, Homo sapiens
  misc_feature: GZ8MTXP02GYI29.44.27.C05.1.454.CMB.2.raw
  modified_base (223)..(223): a, c, t, g, unknown or other
  modified_base (281)..(281): a, c, t, g, unknown or other
  modified_base (316)..(316): a, c, t, g, unknown or other
  modified_base (324)..(324): a, c, t, g, unknown or other
  modified_base (463)..(463): a, c, t, g, unknown or other
tcagacagtatatacacgaccggtgctcgatttagacgcgatcgaagggtttggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacaggtcggtcaccatctcctgcactgganccagcggtaatattcttagtcttaacttgtctcctggtatcacatcatccaggtaacnccccaaatcatcatctatgagccataagcgccctnacgggttntaatgctcactgcctcaacgtcgccaacacgcccgtcctcgacgtaactctctcgggctcccgagctcggagtaccgaggccttagattacttagtttgttggtctcgagtattcgtttcgtagcctatcctatttacngtttccgttcggaaacggtcgggttaacacgggtctacccgggtcttaccgggactacgccgtaacgaccaaccccgactcgcctactctttcccg

SEQ ID NO: 425334 - DNA, 866 bp, Homo sapiens
  misc_feature: GZ8MTXP02J1EA6.44.27.C05.1.454.CMB.2.raw
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcggtggagtcgtgggggaggcgtcggccccgaggtacggggggtccctggagactctcctgtgcagtcctcgtggtacttcctaccttcgaattaagttggaatagtgcgtaggtcgggtcccgccgaggccgtacccgaggggcggaggggtcgtggggtacgggtggggtcggcggtagggttgttcggtactagtttcccgagtaggggaaggtaaaactcgtaaggttcgttacggggtgtacgtttcccggttagggacggggttacccgtaattcccgtaaaccctacgttacccttacccggaaacggtaaccgtaaaccgtaaaccgtttacccggaaacgtaaaaccgtaaccgtaacggtttacggtttacctttacctttaaaccgtaaaacgtaccggtaaaaccgtaccgggttacccgttacggaacccgtaaccccggttacccggaaaccggggtaaacccggtacccggggttacccgggtttacggtttttaaacggtttttcggggtaccggtaaccggtaaacggttaaacctttaacgttacccgttttaaccgtttaaaccccgttaaaaacggtttcccggtttaaccgttaccggtttacccggacccggttacccggggtaccgggggtaaacccccgggg

SEQ ID NO: 425335 - DNA, 578 bp, Homo sapiens
  misc_feature: GZ8MTXP02JMUTG.44.27.C05.1.454.CMB.2.raw
  modified_base (410)..(410): a, c, t, g, unknown or other
  modified_base (444)..(444): a, c, t, g, unknown or other
  modified_base (456)..(456): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggaggcgtggccccagtagggggtccctggagactctcctgtgcagcctctggattcaccttcgataattggaatatgcagtggtccgccagctccgaggcgaggggctgggagtgggtggctagggtgtgtctatttccatggagaaactcgaagtctacgggtgaacgtttccgtagagggccgtagttccacctntactcccagagactaatccgagaacacagtgtcncttacaaacgtnaaacctagccctagacgacctacgacggactacggccgttagttacgttttgtgccgaggtacttacgtacttcgtttaccaaaagttcggttacagttccgacggtccgttaggggacccg

SEQ ID NO: 425336 - DNA, 589 bp, Homo sapiens
  misc_feature: GZ8MTXP02HQCDO.44.27.C05.1.454.CMB.2.raw
  modified_base (266)..(266): a, c, t, g, unknown or other
  modified_base (290)..(290): a, c, t, g, unknown or other
  modified_base (298)..(298): a, c, t, g, unknown or other
  modified_base (377)..(377): a, c, t, g, unknown or other
  modified_base (451)..(451): a, c, t, g, unknown or other
  modified_base (458)..(458): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtacgggggtcctggagactcgtcctgtgcagcctcnggatcaccttgataatggatatgnagtggccncgagcctcgaggcgaggcgtggagtggggtggcaggtgtggctattccagtaggaaggaaatgtaacgtcgtacgggtntacgttccggttagaggggctaattccactatctacagagaacattaccgaataacgacagtatctaccttaanaaagtanacacacagacgacgacgacgacgtacgtacgttacgttagtttgttagtacgtacgtaacgttacgttacttacgttaacgtaaacgttacgttacgtacgtaccggtaccggtaccggtacgggtaccgg

SEQ ID NO: 425337 - DNA, 726 bp, Homo sapiens
  misc_feature: GZ8MTXP02JS7DF.44.27.C05.1.454.CMB.2.raw
  modified_base (271)..(271): a, c, t, g, unknown or other
  modified_base (399)..(399): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccgaggtacgggggtccctgagactctcctgtgcagcctcgtggnttcacctcgataattggaatatgcgaggtcggtcccgacgacggctccgaggcggaggggctggggaggtggggtggcgtagggtgtgtcgtattccgagtaggaagaatacgaagttcgtacgggtntacgttcggttagggacgggtcctacgttaccacccgtactacctacccgaagtacgaaactaaacgttacccggaaagtaaaccgacgtacgtacgttcccttaacctttaaccaaaagtttccggaaaacctacgggtaccccgtagtaacccgtaaccgttacggaaccggtaaccggtaccggtaccggtttacgttttaaggtttttccgaggtaccggtaacggtaacttacgtttaccgtttacgtttaaacccgtaaacgtttccggttaccgttacggttacccggtacccggtcccgggtaaggggtaacccccggg

SEQ ID NO: 425338 - DNA, 691 bp, Homo sapiens
  misc_feature: GZ8MTXP02JIFRG.44.27.C05.1.454.CMB.2.raw
  modified_base (366)..(366): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgctaattcgtggagtcgtgggggaggcggtcggccccgtagggtacggggggtccctggagactctccgtgtgcagcctgtggacttcaccttcgaattaagttggaatagtgcgtaggtcggtccgccgaggtcctaccgagggcggaggggcgtggggacgtggggnggcgtagggttgtgtctagtttcgaggtaggaaagtaactacgaacgttcggtaacggtagttacgttccggttaggacggggtaccctagttaccaaccgtacgtaccgtaccgtaagaacgtaactaacgttaaccgaacgaacgacgtacgtacgttaccttacgttaaccgtaaaagtacgaaaccgtacgtaccgtacgaacgaccgtacgaacgggtaaccgacgggtccgttagtttacgtttgcggtaacgtacgtaccttacgtcttacgttaaccgtaaagttcgttactacgttccgaccggtcgtacccgggg

SEQ ID NO: 425339 - DNA, 541 bp, Homo sapiens
  misc_feature: GZ8MTXP02FWRW1.44.27.C05.1.454.CMB.2.raw
  modified_base (190)..(190): a, c, t, g, unknown or other
  modified_base (238)..(238): a, c, t, g, unknown or other
  modified_base (268)..(268): a, c, t, g, unknown or other
  modified_base (282)..(282): a, c, t, g, unknown or other
  modified_base (294)..(294): a, c, t, g, unknown or other
  modified_base (300)..(300): a, c, t, g, unknown or other
  modified_base (308)..(308): a, c, t, g, unknown or other
  modified_base (345)..(345): a, c, t, g, unknown or other
  modified_base (370)..(370): a, c, t, g, unknown or other
  modified_base (380)..(380): a, c, t, g, unknown or other
  modified_base (390)..(390): a, c, t, g, unknown or other
  modified_base (423)..(423): a, c, t, g, unknown or other
  modified_base (443)..(443): a, c, t, g, unknown or other
  modified_base (500)..(500): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctcgtgtctgggtccncctggacagtcggtcaccatcctctgcactggacgccaggcgttaatnttcttagtcttaattgtctcgtgtatcaantcataccagtaacnccccaaatcatnatctangagactanacggacgccctgtagggtttctaatcgtctcacctcncctacacgtccgacacgcgcctccngacatctcgngctcgacgtnaggaggacgagtctagtagtttaattgttgttnctcgaagtattgttacgganctatactactttatcgttacgtggtaacggtaggactaggtccacgtacgtcgtacncgtaacccgaagaccccaccgtctcgtacctacgtcgtccc

SEQ ID NO: 425340 - DNA, 751 bp, Homo sapiens
  misc_feature: GZ8MTXP02HIT0W.44.27.C05.1.454.CMB.2.raw
  modified_base (189)..(189): a, c, t, g, unknown or other
  modified_base (223)..(223): a, c, t, g, unknown or other
  modified_base (261)..(261): a, c, t, g, unknown or other
  modified_base (276)..(276): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcgtcaccatctcctgcactggacnccagcgtaatattcttagtcttaattgctctgtatcantcatccaaggtaacnccccaaatcatcatctatgacgcctaagtaacgacggtccctacggtaggggtttactaaagtcgtactttacacccgtcgacctaccgtaaacggtcccggacaaacgcccgggtcccttaccctaggaacctaacttccgtccgttcggggaccctttccgaggtacgttagggaacggtaccggagggtaccgttagtaagttttaagtttacgtttcgggttacgtaccttcgtaaaggttaagtttcgggtttaaccgtccggtaacctacgtttaccttaaccgttttaaggttcggttaaccggtttacccgggggtaaaaggttaccgggggtaaaacccttaaaggggttacccctaaacccggttaccggtaaccgggttccgaaaaccggttcccccgtaaaaccggggaccccctaaaaccccgtcgttaaccggtccctaaccggttcccttttcccccggg

SEQ ID NO: 425341 - DNA, 611 bp, Homo sapiens
  misc_feature: GZ8MTXP02JMV78.44.27.C05.1.454.CMB.2.raw
  modified_base (191)..(191): a, c, t, g, unknown or other
  modified_base (238)..(238): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtccncctggacagtcggtcaccatcctcctgcagtggagccagcgtaattnttcttagttcttaacttgtcttctggtatcaacatcataccaacggtaaccacccccaaactcatcatctatgacgtacctagtaagcgtcccgtgtacgggtttctaagtcgtacttcaccgtcgacccgtacacgtccgacaacgcccgtccctcgtacgaactactctacgtccgggcctacgacggtcgtaggacggtaacgtgtacgtagtaattttagttagttcgtagtcctagtacgtagttcggtactcgactatctaagttttcacgttcgtacggacggtacggaacgtacgtacctaccggtactacggacctaccgaccgaaccggtcccaaccctacgtcgtacctccgtccttccccg

SEQ ID NO: 425342 - DNA, 700 bp, Homo sapiens
  misc_feature: GZ8MTXP02I09AZ.44.27.C05.1.454.CMB.2.raw
  modified_base (263)..(263): a, c, t, g, unknown or other
  modified_base (297)..(297): a, c, t, g, unknown or other
  modified_base (392)..(392): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctntggattcaccttgatatggatatgcagtggtccncaggctcgaggcggagggctggaggtgggtgcgtaggtgtcggtactagtttccgagttgggaacgtaaactcgtaaacggttcgtacggggttntaacgtttccggttagaccgggggtaccgtatttccaacccgtattccctacccgaaagacgtaaacctaaacgttcccgaaacgaaacctacgtaagttcgttacctaccgtttaacaaaacgttcgaaacctacggtaccccgttaaggaccgtaacccgtcgaaaccgggtaccgtaaacgggtccgtttagtttacgtttttggacggtaccgtaagtaccttacgttaccgttacgtttaaaccgaaaacgtttccggttactaaccggtttcggaccgtaccggtaccgggggtaaccccgg

SEQ ID NO: 425343 - DNA, 630 bp, Homo sapiens
  misc_feature: GZ8MTXP02FMF7Z.44.27.C05.1.454.CMB.2.raw
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcgtcggccccgaggtacggggggtccctgacgactctcctgtgcagcctctggattcaccttcgataattggaatatgcaggtggtccgccaggcctccgaggcggaggggcgtagggaggtggggtggcgtaggtgtgtctatttcagtggaagaaatcgaagtctacggtgtaacgtttccgtagacgggcctattaccacctactctaccgagaacaactaaacgttccgaaagaaccaacgtagttcgtacttacttacaaatagaaacacgtacctagaccgaccgtacgaacggaccgtacggtccgttagtttacgttttgcgtacgtacgtacttacttctttacgtttaacctaaaacgttccggttactacgtttaccgaccggtccggtaccgggg

SEQ ID NO: 425344 - DNA, 652 bp, Homo sapiens
  misc_feature: GZ8MTXP02I0QWV.44.27.C05.1.454.CMB.2.raw
  modified_base (161)..(161): a, c, t, g, unknown or other
  modified_base (311)..(311): a, c, t, g, unknown or other
  modified_base (517)..(517): a, c, t, g, unknown or other
  modified_base (568)..(568): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttccncgttgccctcttaagaggtgtcatgtgtcaggtgcaattcgtggagtcgtgggggaggcgtggccccgaggtacgggggtccctggagactctcctgtcgcagcctctggacttcaccttcgataattggaatatgctaggtcggtcccncgaggcctccgaggggcgaggggctaggggacggttggggtggcgtagggttgtcgtctagtttcccgagtcggggaagtaaactcgaaaggttcgtacgggtgtaacgtttccgggtgaacgggggtccctagttccacctagtcctccgaagtacgactaatcccgaagtaacacgagtcttacctacttacgaaatcgaaacncgaccgtagaccgacctacgaggaccgaaccgtcgttagtttaacgtttgngtacccgtagtacttaacgttccttacggtttaacccaaaagttccggttaccagttccgaaccggtccggtcggggtaacccg

SEQ ID NO: 425345 - DNA, 716 bp, Homo sapiens
  misc_feature: GZ8MTXP02JAFGX.44.27.C05.1.454.CMB.2.raw
  modified_base (286)..(286): a, c, t, g, unknown or other
  modified_base (310)..(310): a, c, t, g, unknown or other
tcagacagtatatacacgaccggtgctcgatttagacgcgatcgaagggtttggggggaagaggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccaggtagggggtccctgagactctcctgtgcagcctctggattcaccttcgataattggaatatgcagtgggtccncaggctcgaggcggagggctgggngtggggtgcgaggtgtgtctatttcagtggaagtaaatcgaaagtctacggtgactttccggtagacggggccattccacctactcctaccgagaacactaaacgttaccgaaacgaaacacgtacgttacgttacctacgttaacaaaagttacgaaaccgacgtaccgtagaaccgtaccgtacgaacgggacccaaccgggtccgtttagtttacgtttttcggacggtacgtagttactacgttacgtttacgtttaacctaaaacgtttccgggttaacttaccggtttaccggtaaccggttcccgggtaacgggggtaaccccggtaaaccgggggttaaacccccgttcggggttaaccccgtaccccggtttccgttcccccggtttaacccccggg

SEQ ID NO: 425346 - DNA, 648 bp, Homo sapiens
  misc_feature: GZ8MTXP02IZVDH.44.27.C05.1.454.CMB.2.raw
  modified_base (270)..(270): a, c, t, g, unknown or other
  modified_base (272)..(272): a, c, t, g, unknown or other
  modified_base (277)..(277): a, c, t, g, unknown or other
  modified_base (296)..(296): a, c, t, g, unknown or other
  modified_base (508)..(508): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgctaagttcggtggagtcggtgggggaggcggtcggccccgagggtacgggggtccctgacgctctcctgtncngcctntgatcactgataatgaatntgcgagtcggtccacgagctcgaggcggaggcgtggaggtcgggtgcgtaggtgtgttcacgttcagtgggaaagtaatacgaaggttcgtacgggtgttaaacggtttccgtagggtaccgggtaccgtatacccaccgttaactccgtaccaggaacgactaacgtacccgaagaaacctagtacgtatcctactacaaatcgaagaacnccgtagactcccgtagacggtaccgacggtacgttgtttacgttttgaacggtcgtaaacgtacttaacgttccgtttaacgttaacccgaaaagtttccggtaccttacggtacccgacgtaccccggttaaccggggg

SEQ ID NO: 425347 - DNA, 837 bp, Homo sapiens
  misc_feature: GZ8MTXP02GARAS.44.27.C05.1.454.CMB.2.raw
  modified_base (228)..(228): a, c, t, g, unknown or other
  modified_base (603)..(603): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtcgtgggtcgcctggacagtcggtcacctatctcctgcacgtggacnccgagtcggttaattacttcttagttctttaactttgtccttcgtaggtactacaactactacactaccgaacggtaaaccaccccccaaactacctaactcctaactacttaagtacggaacgtaaccgtaagtaaacggacggtaccccgttacgggtaacggggttttacctaaacgttcgtaccttacctacccgtaccgtacccgtaccgtaaccggtacccggaaccaaacccgtcccgggtcccctacccgtacgtaacctactcgtcgttacgggcccttacggaacggtcgtacgggaagggacgcggtacttaggtaattttaggttattggttcctacgttagaagtttgttcgtttccggtanaccgtttacgttaacctttaggtttaacgttacggtttaccgggtttacggggtaaaacggtaccggggttaaaacggtaccgggttaacccggtaacccccgggttaacggttaccgggtaacccgtaaccccggaaaacccccggttaaccccggggaaaaccccccttacccccggtaaaacgttcccccgggtttaaacccacccggttttcccgtttaacccccccggg

SEQ ID NO: 425348 - DNA, 682 bp, Homo sapiens
  misc_feature: GZ8MTXP02GG66N.44.27.C05.1.454.CMB.2.raw
  modified_base (191)..(191): a, c, t, g, unknown or other
  modified_base (544)..(544): a, c, t, g, unknown or other
tcagacagtatatacacgaccggtgctcgatttagacgcgatcgaaggggtttgggggggggtcacaagaggcagcgctctcgggacgtctccaccatggcctgggctctgctgctcctcactctcctcaccaggacacagggtcctgggcccagtctgccctgactcagcctgcctccgtgtctgggtcncctggacagtcggtacaccatctctgcacgtggacgccaggacggttaattattacttagttcttttaactttcgtctcgtggtactacactatcactaccgaacggtaaaccgacccccaaactcaacttacaattacttaagtaggtaacgtaccttaaagtaaacggaccggttacccgttacggttaggggttttaaccttaaagtccgtactttacacccgtccgtacccctaacgtacggtacccgaaccgtaacccgccgggtaccccctaccgtaacgtaacctaactccgttcgtacgggccctacgacggtgaggacgagagtctagtaatttgtattgggtntctagagttagttcgttcggacacttatcttagttattgttacgtagggtaagtacgggtactacggtccaccggttcgtacgcgtaccgacccgtaaacggacccctaaccgtcgacgttcaccgttcctttacccg

SEQ ID NO: 425349 - DNA, 622 bp, Homo sapiens
  misc_feature: GZ8MTXP02FV3NA.44.27.C05.1.454.CMB.2.raw
  modified_base (225)..(225): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcgcctggacagtcgtcaccatcctcctgcactggacnccaggcgtaatattcttagtcttaactttgtctcctggtatacaactatcatccgaaggtaaacgacccccaaactcactcatctatgacggacctataagacggcccttacgtacggggttttactaacgtcgtcttcacctcgtccctacaacgtccgaccaacgccggacctcccagtaccactctacgtcggctccaggctagaggacgaggctagtatttattattgttgactacgtagtagttcgttcggtcactatactactttacgtgttacgttacgggtaaggtacgggaacctacgggtaccgtaccgttacgtacggtaccgaacgtaccccgaacgggaccccaaaccccgtacgttacgtcctaaccgttccgtttaccccgg

SEQ ID NO: 425350 - DNA, 585 bp, Homo sapiens
  misc_feature: GZ8MTXP02H89DL.44.27.C05.1.454.CMB.2.raw
  modified_base (189)..(189): a, c, t, g, unknown or other
  modified_base (222)..(222): a, c, t, g, unknown or other
  modified_base (232)..(232): a, c, t, g, unknown or other
  modified_base (256)..(256): a, c, t, g, unknown or other
  modified_base (259)..(259): a, c, t, g, unknown or other
  modified_base (272)..(272): a, c, t, g, unknown or other
  modified_base (478)..(478): a, c, t, g, unknown or other
  modified_base (566)..(566): a, c, t, g, unknown or other
tcagacagtatatacacgaccggtgctcgatttagacgcgatcgaagggtttgggggggtcacaagaggcagcgctctcggggacgtctccaccatggcctgggctctgctgctcctcactctcctcacccaggacacagggtcctgggcccagtctgccctgactcagcctgcctcgtgtctgggtcncctggacaggtcgtcaccatctcctgcatggancagcgtaatnttctagtcttaattgctctgtatnacntcatcaggtaacnccccaatcatcatctatgacgcctataagcgtccctgtagggtttctaagtccgcttacaccctcgtccctaccaacggtcccgacaaacgccgtacccttccacgtaccaattccgtcgtcgggtcctccgaaggtcgtaggacggtaacgtaggtcttagtactttaattcgttgttacgtctagacgttagtcgtttcggacnctaacgtcttattagttcgtacgtacggtaagtacggacgttaacgtactaccggtactacgaccacgacccgaacgccctaaccgtntacgtactacttcgttccc

SEQ ID NO: 425351 - DNA, 679 bp, Homo sapiens
  misc_feature: GZ8MTXP02FPM5X.44.27.C05.1.454.CMB.2.raw
  modified_base (190)..(190): a, c, t, g, unknown or other
  modified_base (226)..(226): a, c, t, g, unknown or other
  modified_base (239)..(239): a, c, t, g, unknown or other
tcagacagtatatacacgaccggtgctcgatttagacgcgatcgaagggtttggggggggtcacaagaggcagcgctctcgggacgtctccaccatggcctgggctctgctgctcctcactctcctcacccaggacacagggtcctgggcccagtctgccctgactcagcctgcctccgtgtctgggtcncctggacagtcggtcaccatctcctgcacgtggacnccagcgttaaatnttcttagtcttaactttgtctcgtgtatacaacatcactaccgaacggtaaaccgacccctaaaactcaactctaactacttagtacgacggtacctaaataacggacggccccttaggtaaggggttttacaaactcgtacttcacctcgacctacaacgtccggacaaacgccgcctcctagactactctcgcggcctacgacgtcgtaagaggacgaggcttagtaatttattagttcgttacgactacggtagtagtttcgttcggtacacctataccttaagtttctacgttacggttaacgggtaaaggttacgggaaaccgtaaaggttcccgtaaaccggttacgttaacgtaccgaaccggtaaaccccgaaacggtacccctaaaaacccccgtgttaccggtacctaaccgttcccgtttaacccccgg

SEQ ID NO: 425352 - DNA, 716 bp, Homo sapiens
  misc_feature: GZ8MTXP02H4BSA.44.27.C05.1.454.CMB.2.raw
  modified_base (375)..(375): a, c, t, g, unknown or other
tcagacagtatatacacgaccggtgctcgatttagacgcgatcgaagggtttggggcctgggagacgagccccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggagcgtggccccgaggtacgggggtccctgagacctctcctgtgcacgcctcgtggtacttcctacctttcgattaaagttggaatatgcgaggtcgggtcccgccgaggccgtccgaggcggaggggcgtagggacggtggggtggcgtaggtgtgtntatttcgagtaggaggaaatcgaagttcgtagggtgtaacgtttcccggtagggacggtcctaattccgaccctatccgtacccgaagtacgtaacctaaacgttaccgaactaaaccgaacgacgttacgttacgtaccttaaacgtaaaagtacgaaaccgtaacggccgttaacggacgtacccgtacgaacgggtaacccggtacgggtacgtttacggtttaagtttttcgggtacggtaccggtaacggttaactttacttacgtttaaccgtttaaccgttaaaacgttccggttactacggttaccggaccggtccgggttacggggacccgg

SEQ ID NO: 425353 - DNA, 705 bp, Homo sapiens
  misc_feature: GZ8MTXP02JMRE1.44.27.C05.1.454.CMB.2.raw
  modified_base (201)..(201): a, c, t, g, unknown or other
  modified_base (277)..(277): a, c, t, g, unknown or other
  modified_base (279)..(279): a, c, t, g, unknown or other
  modified_base (284)..(284): a, c, t, g, unknown or other
  modified_base (288)..(288): a, c, t, g, unknown or other
  modified_base (378)..(378): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctggagctgggttttcctcgttcgcccttcttaagaggtgtcatgtgtcaggtncaattcggtggaggtcgtgggggagggcggttcggccccgagggtacggggggtccctggacgtactctccgtgtncngcctntggnttcaccttgatatggatatgacgaggtcggtccgccagggtccctacggaggggccggagggggcgtgggaacgggttggggaggtcggngggttgtgtactagtttcgagtggaaaacgtatacgaaggttccgtaagggtgtaaggttcccggtaggacggggaccttagttacccacctacttaccgacctaaggaacgtaactaacgttaccccgaaaggaaccctaaagacgttggttacccttatttaaaccaaaacgttacgaaacggaaccacccggttagaaaccgcccgttaaccggacggaccgtaaccgggtaccgttgtttacggttttgcggtacgtagtaccgtttattccgttaacttaacgtaaacgttcggttataccgttcgaccgtccggtaacggg

SEQ ID NO: 425354 - DNA, 652 bp, Homo sapiens
  misc_feature: GZ8MTXP02I28Z3.44.27.C05.1.454.CMB.2.raw
  modified_base (268)..(268): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtcggccccgaggtacgggggtccctggagactctcctgtgcagcctntggattcacttgataatggaatatgcaggtcggtccgcaggcctccgaggcggaggggcgtgggaggtggggtggcgaggtgtgtctatttcgagtaggaagtaaactcgaaacgttctaggggtgtacgttccggttggacgggggtcctaaacgttccaacccgtactcctaccgaagaacgaactaaacgttaccgaacgaacacgtagttacgttacttacttaacaaattacgaactacgcctacgacgtaccctacggacggacgtaccggtacgttacgtttagttttggacgtacgtacgtactttactacgtttacgtttaacctaaaacgttcggttacgtacgttaccggaccgtccggtacggggtacccgg

SEQ ID NO: 425355 - DNA, 616 bp, Homo sapiens
  misc_feature: GZ8MTXP02FZBLY.44.27.C05.1.454.CMB.2.raw
  modified_base (266)..(266): a, c, t, g, unknown or other
  modified_base (273)..(273): a, c, t, g, unknown or other
  modified_base (325)..(325): a, c, t, g, unknown or other
  modified_base (342)..(342): a, c, t, g, unknown or other
  modified_base (349)..(349): a, c, t, g, unknown or other
  modified_base (351)..(351): a, c, t, g, unknown or other
  modified_base (392)..(392): a, c, t, g, unknown or other
  modified_base (464)..(464): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcggtggagtcgtgggggaggcgtcggccccgaggtacggggggtccctggacgacttctcctgtncagcctntggtacttccaccttcgataagttgaatatgcaggtcggtccgcgagctcgnggcgaggggctaggggnggtgggngngtggtgtgtctattcgagtagaagtaatcgtagtcgtggtntacgtcggtgacggtctactccactatccacgagacactaacgtacgaacaacgtatagtcttactactaanaacgtacgaacacgaccgtagacgaccgtacgaacgaccgtaccggtcgttagtttacgtttcggacgtacgtagttacttacgttacgttaacgtttaaaccgtaaacgtttcggtactacggttaccgaccggtacggtacgggaacccg

SEQ ID NO: 425356 - DNA, 753 bp, Homo sapiens
  misc_feature: GZ8MTXP02GIIM4.44.27.C05.1.454.CMB.2.raw
  modified_base (354)..(354): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttggctgagctgggttttcctcgttgccctcttaagaggtgtcatgtgtcaggtgcaattcgtggagtcgtgggggaggcgtggccccgaggtagggggtccctggagtactctcctgtgcagcctcgtggattcacttcgataattggaatatgcgagtcggtccgccgtaggcctcgaggtcggagggctggggagtggggtgcgagggtgtntgtatttccgagttaggaacggtaaattcgtaaaggttcttaccgggggtataaacggtttccgggtttacggaaggggtacccggtaactttacccgaacccgttacttacccggttacctaaaaccggaaggtaaaccctttaaacgttacccccggaaaaggttaaaaccctaccgaaaacggggtttcgttaacccgtttaccgtttaaacgtaaaacgttacggtaaaaccgtacggtacccgttaacggaccgtaacccgtacgaaacggaccgttacgggtaccgtttacggtttaacgtttcggtacgtacgtaacgttaccttagttaccgtttacgttaaacgaagtttaccgttacgtacgttaccgacggtaccggtacgggaaccg

SEQ ID NO: 425357 - DNA, 699 bp, Homo sapiens
  misc_feature: GZ8MTXP02GGZ6G.44.27.C05.1.454.CMB.2.raw
  modified_base (343)..(343): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagtctgggttttcctcgttgccctcttaagaggtgtcatgtgtcaggtgctaagttcgtggagtcgtgggggagcgtcggccccgaggtacgggggtccctgacgacttctcctagtgcagcctgtgtattcaccttcgatacttggaatatgcaggtcggtccgcgtagctccgaggcgagggctgggagtgggngcgaggtgtgtctattcagtggagtaactcgaagttctacggtgtacgtttccggttagacggggtacccgtagttacccgaacctactaccgttacccgaacggtaaccgtaaaccgtaaacgttacccggtaacgtaaaaccgacgtaaccgttacggtaccgttaccttaacgaaaacgtacgaaaccgtacgtaccgaggtaccgtaaccgttaccgaacggaccgtaacgggtccgtttaggtttaacgtttttgacggtacgtaaggtaaccttagttaccgtttaagtttaaaacctaaagttccggttaacctacgttaccgtaccggtaccgtcggggtaaacccgg

SEQ ID NO: 425358 - DNA, 757 bp, Homo sapiens
  misc_feature: GZ8MTXP02HV0Y1.44.27.C05.1.454.CMB.2.raw
  modified_base (269)..(269): a, c, t, g, unknown or other
  modified_base (295)..(295): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtcgtgggggaggcgtggccccaggtagggggtccctggagactctccgtgtgcagcctntggatcactcgataatggaatatgcnggtggtccgccgacggctaccgaggcggaggggctgggagggtggggtggcgaggtgtgtctactttcagtgggaaggtaaatcgaagtcgttacgggtagtacgtttccggttaggacggggaccctaagttaccacccgtataccgtacccgtaagaacgaacgaaacgtttcccggaaaacgaaaacctaccgtaaggttacgttaaccctttactttaacgtaaaacttaggaaaaccgtaaccgtaccgttaacggaaccgtaacccgttaaccggaaacggggaaacccgtaaccgggggtaccccggtttaagttttaaccggttttttgggacgttaacccggtaaacgttaacgttaccgtttacccggttaacgttttaaacccgtaaaaacgtttcccgggtttaactaacggtttaccccggaaccggtaccccggtttaacccgggggg

SEQ ID NO: 425359 - DNA, 724 bp, Homo sapiens
  misc_feature: GZ8MTXP02HPWCU.44.27.C05.1.454.CMB.2.raw
  modified_base (211)..(211): a, c, t, g, unknown or other
  modified_base (285)..(285): a, c, t, g, unknown or other
  modified_base (345)..(345): a, c, t, g, unknown or other
  modified_base (371)..(371): a, c, t, g, unknown or other
tcagacagtatatacacgaccggtgctcgatttagacgcgatcgaagggtttgggctgagctgggttttcctcgttgccctcttaagaggtgtcatgtgtcaggtgcaattcgtggagtctgggggaggcgtggccccagtaggggggtccctgagactctcctgtgcagctctggattcaccttgataattggaatatgcagtgggtccnccaggctcaggcggagggctggagtgggtggcagggtgtgtcatttcagtggaagaaatcaaagtctaacggtntacgttcgtaggacggtcctataccactactccaccgaagaacgaactaagttaccgaanaacacgtagttcgtacctacgttaanaaaagtaccgaaaccgacgtccctagaactaccctacgacggtaccgtaccggtcgtttagtttacgtttcggatacgtaagtacttagttcgttacgttaaaccgtaaacgtttcgttacgtacgttaccggaccgtaccggtaccggggaccgtaaaccgggtacccgttacgggtacccgtacccgttccgtacccgtacccggacccgtacccgaacccggtaacccggtccctaccgttcccgttccccgttacccccggtcggtaccccgtccccgttccgaccccgtaccgtaccggaccgtaccgtaacccgtaccgacgacgaccgaccgaccgccggtcccgg

SEQ ID NO: 425360 - DNA, 658 bp, Homo sapiens
  misc_feature: GZ8MTXP02GWUN8.44.27.C05.1.454.CMB.2.raw
  modified_base (202)..(202): a, c, t, g, unknown or other
  modified_base (308)..(308): a, c, t, g, unknown or other
  modified_base (323)..(323): a, c, t, g, unknown or other
tcagacagtatatacacgaccggtgctcgatttagacgcgatcgaagggtttggggagccctgggagacgagcccagcactggaagtcgccggtgtttccactcggtgatcatcactgaacacagaggactcaccatggagtttgggctgagtcttgggttttcctcgttcgcccttcttaagaggtgtcatgtgtcaggtncaattcgtggagtcgtgggggagcgtggccccagggtacgggggtccctggagtactctcctgtagcagccctgtggacttccaccttcgattaaagttggaaatntgcaggtcggtcccncgaggcctcgaggccggaggggcctggggagtcggggtcgacgtaggtcgtgtctagtttacgagtagggaagtaaacgtcaaaggttcgtacggtgtacgttccgggtaggtacgggcctagttaccgacctagttcccaaccgagaacgaactaacgttaccgaacgaaacacgtagttacgtaccttacttactaaatcgaacacgtacctacgacgtacacgacgacgtacggtacgttagttacgtttgtacgtacgtacgtactacgttcttaacgttaaccgtaaaacttcggttactacgtaccggtaccgtacgggtaacccgggg

SEQ ID NO: 425361 - DNA, 604 bp, Homo sapiens
  misc_feature: GZ8MTXP02HVR53.44.27.C05.1.454.CMB.2.raw
  modified_base (180)..(180): a, c, t, g, unknown or other
  modified_base (343)..(343): a, c, t, g, unknown or other
  modified_base (462)..(462): a, c, t, g, unknown or other
tcagacagtatatacacgaccggtgctcgatttagacgcgatcgaagggtttgggggccctgggagacgagcccagcactggaagtcgccggtgtttccactcggtgatcatcactgaacacagaggactcaccatggagtttgggctgagctggggttttcctcgttgccctcttaagnggtgtcatgtgtcaggtgcaattcgtggagtctgggggaggcgtggccccaggtaggggggtccctgagactctcctgtgcagcctctggattcaccttcgataattggaatatgcagtggtccgccaggctcgaggcggaggggcgtggagtggggtggcgnggtgtgtcatttccgagtgaggaaatcaagtctacggtgtattccgttgaggggccgattcaccctatccgtccagagaaccaattcccgaagaacacagtctactctttaccaaatanaacgtagaccttagacgaccgtaccaggaaccacgggtaccgtgttactttttagtcggacgaagtccttacgttccttgtttaccctaaaaagttccggtttactaccttacgggtacccgaccggttccgggggacccgg

SEQ ID NO: 425362 - DNA, 677 bp, Homo sapiens
  misc_feature: GZ8MTXP02G0P7S.44.27.C05.1.454.CMB.2.raw
  modified_base (273)..(273): a, c, t, g, unknown or other
  modified_base (369)..(369): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagcttgggttttcctcgttgccctcttaagaggtgtcatgtgtcaggtgcaattcgtggagtcgtgggggaggcggtgggcccccgaggtacggggggtccctggacgactctcctgtgcagcctnggatcaccttcgataagttggaatagtgcgaggtcggtccgccgaggcctccgaggcggaggggctagggaggtggggtggcgagggtgtgtactnttccgatggaagaatcgaagttcgtacggtgtaacgttcggttggaggggtcccagttacccaaccgtacttccgtacccgaaggacgaaccgtaaacgttcccggaaagaaaccgtaacgtaacgttacgttaccttccttaacctaaaagtacgtaacacggtcccgtacgaacggtacctacggaacggaccgaccgggtaccggttagtttaacggtttttggtagtacggtactacggttactccgttacgtttactaaaacgttcgttacgtacgttccgacggtaccggtcgggaacccgg

SEQ ID NO: 425363 - DNA, 595 bp, Homo sapiens
  misc_feature: GZ8MTXP02I06JR.44.27.C05.1.454.CMB.2.raw
  modified_base (188)..(188): a, c, t, g, unknown or other
  modified_base (224)..(224): a, c, t, g, unknown or other
  modified_base (235)..(235): a, c, t, g, unknown or other
  modified_base (266)..(266): a, c, t, g, unknown or other
  modified_base (467)..(467): a, c, t, g, unknown or other
tcagacagtatatacacgaccggtgctcgatttagacgcgatcgaagggtttgggggggtcacaagaggcagcgctctcgggacgtctccaccatggcctgggctctgctgctcctcactctcctcacccaggacacagggtcctgggcccagtctgccctgactcagcctgcctcgtgtctgggtcncctggacagtcggtcaccatcctcctgcacgtgganccagcgtaatnttctagtcttaactttgtctctgtatcaacntcatccaggtaacacccccaaatcatcatctatgacgcctataacggacgtcccgtgtagggtttctaatccgtcttcacctcgcctacgaacgtccggaccaacgccggtcctccctagacctactctcgtgggacctcgaggtctaggacggacgaggccttagtaactttagttagtttcgtagtcttacgtaaggtnttcggtttcgtacgactacgttactacttagtcgttacgtagggtagtacgggacgtacgtccgtaccgttctacggtacacgacccaacggacccctaaaccgtcgtacgtacctacctcttacccg

SEQ ID NO: 425364 - DNA, 702 bp, Homo sapiens
  misc_feature: GZ8MTXP02FMOBO.44.27.C05.1.454.CMB.2.raw
  modified_base (264)..(264): a, c, t, g, unknown or other
  modified_base (268)..(268): a, c, t, g, unknown or other
  modified_base (291)..(291): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgcccctctttaagaggtgtcatgtgtcaggtgcaattcgtggagtcgtgggggagcgtggccccaggtagggggtccctgagactctctgtgcagcctntggnttcacttcgataatggaatatgnaggtggtccgctagcctcgaggcgagggctaggaggtgggtgcgagggtgtgtcttatttcccgagttcggaaaggtaaatcgaaaggttcgtagggttgaacgttttccgggttaggaacgggggttcccgtaaatttcccgtaaaccctacgttacccttacccaaggaacggtaaccctaaacgtttcccgaaacggtaaacaccgtaaggtcgtaccttactttaaccaaattacggaaactacgtacctacggtaacgacccgtacgaacgggaacccgaacgggtcccgttaggtttaacgtttttggacgtaccggtaggtaaccttaacgtttcgttaacgtttaacccgtaaaagttccggtttactacgtttaccgaccgttccgtacgggggtaaccccg

SEQ ID NO: 425365 - DNA, 753 bp, Homo sapiens
  misc_feature: GZ8MTXP02GJES3.44.27.C05.1.454.CMB.2.raw
  modified_base (195)..(195): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtncaattcgtggagtcgtgggggaggcgtggccccaggtagggggtccctgagctctcctgtgcagcctctggtattccaccttcgataattggatatgcaggtcgggtccgccgagcctcgaggtcggaggggctggaggtgggtggcgaggtgtgtctattcagtaggagaaactgaagttcgtacgggtgtaacgtttccgggttagggacgggtccgtacgttacccgaaaccgtacgttaaccctacggaaacgtaaccggtaaaccgtaaacttaaccccaaaagggaaaccctaaccggtacccgttaggttaaaacgttccctttaacgggaacctaaaaagttacccgtaaaacgggaaccgtaccccggttaggaacggtacgggaacccccgggaagggtaacccgaaaccgggtccggttacgggtaggtttaaaccgtttacggttaaagggttcgggtacccgaaaaggggccttaaaaggttcgtttaaaacggttaaacgttacccgttaaccccggtaccgtacgtaccgggtttaaaccggg

SEQ ID NO: 425366 - DNA, 775 bp, Homo sapiens
  misc_feature: GZ8MTXP02GK6MP.44.27.C05.1.454.CMB.2.raw
  modified_base (283)..(283): a, c, t, g, unknown or other
  modified_base (296)..(296): a, c, t, g, unknown or other
tcagacagtatatacacgaccggtgctcgatttagacgcgatcgaagggtttggggctgggagacgagcccagcactggaagtcgccggtgtttccactcggtgatcatcactgaacacagaggactcaccatggagtttgggctgagctgggttttcctcgttgccctcttaagaggtgtcatgtgtcagtgcaattcgtggagtcgtgggggagcgtggccccaggtagggggtccctgagactctcctgtgcagcctctggattcacttcgatatgaatntgcagtcggtccncacggctaccgaggccggaggggcctaggggtaggttggggtcggcgtagggtggtgtaccgttagtttcccgagttaggggaagaaaactccgtaaaggttcgttaccgggtgacgttttccggtagggacggggacctagttaccgaccctacgtaccgtaccacggaagaaaccgtaagtacccgaaagtaaacccggtacaacgggttcggttacccttaacttaaacgtaaaacggttacgaaaccgtaaacgtcccgttaaaccgaacggtaccccgacgtaaaccggggaccggtaaacccgttcgggggtttaaccgttttaagtttttcccgggtaggttaaccggtaaaccgtacgtttaaacgttaccgttaacccggttttaaaaccgtaaaacggttttacccggtttacgttacccgggtttaacggtacccggttaacccggggttccgggtaaaccccggggg

SEQ ID NO: 425367 - DNA, 695 bp, Homo sapiens
  misc_feature: GZ8MTXP02JTMDY.44.27.C05.1.454.CMB.2.raw
  modified_base (300)..(300): a, c, t, g, unknown or other
tcagacagtatatacacgaccggtgctcgatttagacgcgatcgaagggtttggggcctgggagacgagcccagcactggaagtcgccggtgtttccactcggtgatcatcactgaacacagaggactcaccatggagtttgggctgagctgggttttcctcgttgccctcttaagaggtgtcatgtgtcaggtgcaattcgtggagtctgggggagcgtggccccaggtagggggtccctgagactctctgtgcagcctctggattcaccttcgataattggaatatgcaggtggtccncagctccaggcgagggctggagtgggtggcaggtgtgtctatttccagtggagaaatcgaagttcgtacggtgaacgttccccggttagaacggggtcccgtatttcccgaaaccctcgttaccgtcccgaaacggacggtaaacccgtaacgtttacccggaaacggaaaacctacgtaaacgtcggttactcctttaaccaaagttacggaaacctacggtacccgttagaaaccggtacccgttacgaagggtaacccgtaccggggtacccgttagttttaacgtttttcggacggtaccggaaagttacccttaagtccgtttacgttttaaccgaaaacgtttccggttacgtacgtttaccggaccgtccggtttaccggggacccgg

SEQ ID NO: 425368 - DNA, 552 bp, Homo sapiens
  misc_feature: GZ8MTXP01D7HEN.25.87.H10.1.454.CMB.2.raw
  modified_base (222)..(222): a, c, t, g, unknown or other
  modified_base (414)..(414): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccagcccccaggagggcctggagtggattgcgattgtctttcatagtgggagtgcctacttacagtcccctcccctcaagagtccgagtccaccaatttcggtgacacgtccacgcagcagttgtctctgacactgacgtctgtcacggccnccggacgacgggccgtctacttactgtgcgagagtcagcggtcggaaaacccctacgaaaccccttatttcgacctaccgttcgggggcccacgggggaacccgtcgggtccaacccggtcacccgtcaacggtcccc

SEQ ID NO: 425369 - DNA, 521 bp, Homo sapiens
  misc_feature: GZ8MTXP01DWZG6.25.87.H10.1.454.CMB.2.raw
  modified_base (203)..(203): a, c, t, g, unknown or other
  modified_base (222)..(222): a, c, t, g, unknown or other
  modified_base (249)..(249): a, c, t, g, unknown or other
  modified_base (259)..(259): a, c, t, g, unknown or other
  modified_base (342)..(342): a, c, t, g, unknown or other
  modified_base (436)..(436): a, c, t, g, unknown or other
  modified_base (445)..(445): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactccatcaccagtaatgctcattacnggggctggcnccgccagccccagggaggcctggagtggattgcgattgtctttcatagtgggagtgcctactacacgtcccctcccctcaagngtcgagtccacctgtttcggttgacacgtccacgcagcagttgtctctgacactgacgtctgtcacggccgccgacgacggtccgtctattacngtgcgaagngtcacgcggtcggaaacccctcaacccctcttgacctcgttcggggccagggaacctggcacgcacctcgcgtccc

SEQ ID NO: 425370 - DNA, 596 bp, Homo sapiens
  misc_feature: GZ8MTXP01DYILU.25.87.H10.1.454.CMB.2.raw
  modified_base (222)..(222): a, c, t, g, unknown or other
  modified_base (242)..(242): a, c, t, g, unknown or other
  modified_base (248)..(248): a, c, t, g, unknown or other
  modified_base (344)..(344): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctnattacnggggctggctccgccacgcccccgagggaagggcctggagtggattgcgtattgtctttcataggtgggagtgcctactacacgtccctccccctnaagagtcgagtcacctgtttcggtgaccacgtccacgcagctagttgtctctgacactgacgtctgtcacggcccgccgacgaccgggccgttactacgttaccgtgttcggccgaagtgtccacggtcccgggttaaccggaaaaccccctacttaaaccccctagttttcgaaccgtaccgttcgggggccccaagggggtaaccccgtgggtaacccaacccggttccgaacccttcgaacggtccccc

SEQ ID NO: 425371 - DNA, 559 bp, Homo sapiens
  misc_feature: GZ8MTXP01CB0OJ.25.87.H10.1.454.CMB.2.raw
  modified_base (222)..(222): a, c, t, g, unknown or other
  modified_base (452)..(452): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactgggctggctccgccagcccccgagggagggcctggagtggattgcgattgtctttcatagtgggagtgcctactacacgtcccctccccctcaagacgtcgacgtacacctaagtttcggtgacacgtccacgcagctagttgtctctgacactgacgtctgtcacggccgcccgacgcggcctcgtacttactgtcgcgagngtcagtccggtcggaaaccccctacgttaacccctacgtttcgaacctccgttcgggggttcccaggggtaaccctgggtccacccggtcacccgtcaacggtcccc

SEQ ID NO: 425372 - DNA, 602 bp, Homo sapiens
  misc_feature: GZ8MTXP01DQDKQ.25.87.H10.1.454.CMB.2.raw
  modified_base (222)..(222): a, c, t, g, unknown or other
  modified_base (257)..(257): a, c, t, g, unknown or other
  modified_base (345)..(345): a, c, t, g, unknown or other
  modified_base (349)..(349): a, c, t, g, unknown or other
  modified_base (394)..(394): a, c, t, g, unknown or other
  modified_base (398)..(398): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgtgggctggcnccgccacgcccccgaagggacggcctggagtggattgcgtattgtctttcagtaggtgggatcgcctactacacgtcccctcccctanaagngtcgagtaccacctgtttcggtgacacgtccacgcagctagttcnctcnactacgtcgtacgtcgcgtccgaccggcccgaccgacggaccggtctactacgttacgtgtcgacgtagcgtacgacggtaccggtaacccgaaacccctaccttaaccccgttacgttaccgaacccggtaccgggttcggggacccggttaacggggtaaccgtcggtaacccgtacccgtaccacccgtccgaaccgtccc

SEQ ID NO: 425373 - DNA, 546 bp, Homo sapiens
  misc_feature: GZ8MTXP01EM0MG.25.87.H10.1.454.CMB.2.raw
  modified_base (222)..(222): a, c, t, g, unknown or other
  modified_base (527)..(527): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattactggggctggctccgccacgcccccgagggaacggcctggagtggattgcgtattgtctttcagtagtgggagtcgccttactacacgtcccctcccctacaagagtcgagtccacctgtttcggtgactacgtccacgcaagctagttgtctctgactactgtacgtctgccacggccgcccgacacgtaccgtctagttactgtgcgagagtcaggccggtacgaaacccctcaacccctctttacgacaccgttcggggccacggggaaccgtggtccnccgtcacctcgcgaacccc

SEQ ID NO: 425374 - DNA, 598 bp, Homo sapiens
  misc_feature: GZ8MTXP01DH8HS.25.87.H10.1.454.CMB.2.raw
  modified_base (222)..(222): a, c, t, g, unknown or other
  modified_base (247)..(247): a, c, t, g, unknown or other
  modified_base (348)..(348): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacnggggctggctccgccacgcccccgagggacggcctggagtggattgcgtattgtctttcagtagtgggtagtgtcctactacacgtcccctcccctcaagngtcgagtacactgtttcggtgactacgtccacgcagctagttgtctctgacactgacgtctgtcacggcccgccgacgaccgggtccgttacttacttaccgtggtgacggagtacgtcacggtccgggtaacggaaaacccccttacaaacccccgtttacgtttacggaaccgtacccggttcggggggcccaaagggggtaaccccgtggtaacccacccggttcaacccgtccgaacggtcccccg

SEQ ID NO: 425375 - DNA, 756 bp, Homo sapiens
  misc_feature: GZ8MTXP01C86UW.25.87.H10.1.454.CMB.2.raw
  modified_base (222)..(222): a, c, t, g, unknown or other
  modified_base (247)..(247): a, c, t, g, unknown or other
  modified_base (257)..(257): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgnggggctggcnccgcacgccccgagggaacggccgtggagtggattgcgtatttcgttcttttcagttaggtggggtagtcgtaccttactacacgttccccctaccctacgaaagtgtaccgacgtaccaaccttgtttcgggttcgaaccctacggtcccaacgggcaacggtctaacggtttcgtactcgttcggaaaccacgttcggaacgttcctcggtaccgacccgggtaccccggaccccggtaaccggtaacccggggtcccggtttaacctttaaacgtttaccggtcggtttacgggacccgaagggtaccggttcccggaacggggttacccgggggttaaaccccgggaaaaaacccccctttccgaaaaccccccgttttacgtttacggaaaccccggttacccggggttacggggggcccttaaacggggggtaaccccgttagggtcccctaaacccgggtccttaccccgttcgaacccggttaaccccccg

SEQ ID NO: 425376 - DNA, 604 bp, Homo sapiens
  misc_feature: GZ8MTXP01A0APF.25.87.H10.1.454.CMB.2.raw
  modified_base (222)..(222): a, c, t, g, unknown or other
  modified_base (240)..(240): a, c, t, g, unknown or other
  modified_base (247)..(247): a, c, t, g, unknown or other
  modified_base (256)..(256): a, c, t, g, unknown or other
  modified_base (301)..(301): a, c, t, g, unknown or other
  modified_base (339)..(339): a, c, t, g, unknown or other
  modified_base (343)..(343): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattacgngggctggcnccgcacgccccgagggacggctggagtggatgcgtattgtctttnagtaggtgggagtcgcctactacacgtccctcccctanaagngtcgagtaccacgttgtttcggtcgactaccgtccacgcacgctagttgtctctagactacgtgtacgtcgtgccgaccggccgacccgacggtaccgggtccttactacttaccgtgacgtacggagtcgtccgaacgggtacccggtaaccggaaaaccccttaccgaaccccgtttagttaccggaaccgtaccgggttcgggggcccttaacggggtaacccgtcgtaacccgacgttccacctcgccgtaaccccg

SEQ ID NO: 425377 - DNA, 592 bp, Homo sapiens
  misc_feature: GZ8MTXP01D4UM8.25.87.H10.1.454.CMB.2.raw
  modified_base (204)..(204): a, c, t, g, unknown or other
  modified_base (223)..(223): a, c, t, g, unknown or other
  modified_base (249)..(249): a, c, t, g, unknown or other
  modified_base (259)..(259): a, c, t, g, unknown or other
  modified_base (458)..(458): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctnacctgctctgtctctggtnactccatcacagtaatgctcattacnggggctggcnccgccagcccccgagggaggcctggagtggattgcgtattgtctttcagtaggtgggagtcgccttactacacgtcccctccccctacaagacgtcgagtaccacctaagtttcggtgactacgtccacgcagcagttgtctctgacactgacgtctgcacggccgccgacgacggccgttctattacctgtgcgtagngtcgagtccggtacggaaaaccccctcgaaacccccttacgtttacgaacccgtcccggttacgggggcccaacgggggtaaccccgttgggtaaccctacccgggttccaacccgttcccaaccggtcccccg

SEQ ID NO: 425378 - DNA, 546 bp, Homo sapiens
  misc_feature: GZ8MTXP01B7950.25.87.H10.1.454.CMB.2.raw
  modified_base (222)..(222): a, c, t, g, unknown or other
  modified_base (345)..(345): a, c, t, g, unknown or other
  modified_base (367)..(367): a, c, t, g, unknown or other
  modified_base (520)..(520): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattactggggctggctccgccacgcccccgagggaacggcctggagtggattgcgtattgtctttcagtagtgggagtgcctactacacgtccctcctcaagngtcgagtcaacctatttcggtnacacgtccacgcagcagttgtctctgacactgacgtctgtccacggccgccgacacggggccgttctattactgtcgcgagagtcaggtccgtacggaaacccctaacgaaccccttcttcgactaccgtgggccgagggaaccgtggtaccnccgtcgaccttcaacgccctaacccg

SEQ ID NO: 425379 - DNA, 638 bp, Homo sapiens
  misc_feature: GZ8MTXP01BWU80.25.87.H10.1.454.CMB.2.raw
  modified_base (223)..(223): a, c, t, g, unknown or other
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcaccagtaatgctcattacgngggctggctccgccacgcccccgagggacggcctggagtggatgcgtattgtctttcattaggtgggagtgccttactacacgtcccctcccctacaagcgtcgagtaccacctaagtttcggtgaccacgtccacgcagcagttgtctctgactactgacgtctcgtccgaccgggccgacccgacgaccgggtcccgttactacgtttaccgtggcgacgaacggtcgtccgaacggtcccgggttaaccgggaaaaccccccttacgttaaaccccccctttagtttaccggacccgtaacccggttcggggggacccgaacgggggtaaccccgtggggttaaccccaacccgggtcccaacccgttccgaaccggtcccccg

SEQ ID NO: 425380 - DNA, 643 bp, Homo sapiens
  misc_feature: GZ8MTXP01A9LP0.25.87.H10.1.454.CMB.2.raw
  modified_base (221)..(221): a, c, t, g, unknown or other
  modified_base (246)..(246): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcacagtatgctcattacgngggctggctccgccacgccccgagggacggcctggagtggattgcgtattgtctttcatagtgggatgcctactacacgtccctcccctacaagacgtcgagtacacctaatttcggtagacctacgtccacgcagctagttgctctgactacgtgacgttctgtccaccgggccgacccgacggacccgggtccgttactaacgtttacgtcggttcgccggaaaggtcgttaccggaacggtcccgggttaaccgggaaaaccccccttacggttaaaccccccttagttttaccggaacccgtaaccggttcgggggacccgttaacgggggtaaaccccttcgggggttaaccccacccgggttacccgaacccttccgaaccggtccccccg

SEQ ID NO: 425381 - DNA, 563 bp, Homo sapiens
  misc_feature: GZ8MTXP01BF82F.25.87.H10.1.454.CMB.2.raw
  modified_base (222)..(222): a, c, t, g, unknown or other
  modified_base (248)..(248): a, c, t, g, unknown or other
  modified_base (308)..(308): a, c, t, g, unknown or other
  modified_base (376)..(376): a, c, t, g, unknown or other
  modified_base (380)..(380): a, c, t, g, unknown or other
  modified_base (445)..(445): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgngggctggctccgccacgcccccgagggaacggcctggagtggattggcgtattgtctttnagtaggtgggagtcgccttactacacgtcccctcccctacaagagtcgagtccacctgtttcggttanaccncgtccacgcagcagttgctctgacactgacgtctgcacggcacgccgacgacgccgtctattacngtcgagtagngtcacggccgggtaacgaaaccccttacaaaccccctttagttcgaaccttccgttggggacccaacggggaccgttcggaccctacggttaccaaccttccgaaccg

SEQ ID NO: 425382 - DNA, 533 bp, Homo sapiens
  misc_feature: GZ8MTXP01CHYEY.25.87.H10.1.454.CMB.2.raw
  modified_base (222)..(222): a, c, t, g, unknown or other
  modified_base (345)..(345): a, c, t, g, unknown or other
  modified_base (398)..(398): a, c, t, g, unknown or other
  modified_base (413)..(413): a, c, t, g, unknown or other
  modified_base (437)..(437): a, c, t, g, unknown or other
  modified_base (443)..(443): a, c, t, g, unknown or other
  modified_base (472)..(472): a, c, t, g, unknown or other
  modified_base (487)..(487): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattactggggctggctccgccacgcccccagggaagggcctggagtggattggcgattgtctttcagtaggtgggagtgcctactacacgtccctcccctcaagngtcgagtaccacctaagtttcggttcgactacgtccacgcagctagttgtctntgacactcgacgtcngtcacggccgccgacgcggccgtnattacngtgcgagagtcagcggtgaaaccccctanaccccttattcgacncgttcggggccaaggggaaccctgtccaccgtcaccctgcgtcccc

SEQ ID NO: 425383 - DNA, 596 bp, Homo sapiens
  misc_feature: GZ8MTXP01EA91K.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgtggggctggctccgccacgcccccgagggagggcctggagtggattgcgtattgtctttcagttagtgggagtgccttactacacgtcccctcccctacaagagtcgagtaccacctaagtttcggttagaccacgtccacgcagcagttgtctctgacactcgtacgtctgtccgacggccgcccgacgacggtccgttactattacctgtcgcgagagtcgacggtcggtaccggaaacccctaccgaaccccttactttacgaacccgtacccggttcgggggcccgaacggggtaacccgtcgggtcccaacccggttccaaccctccgaacggtaaccccc

SEQ ID NO: 425384 - DNA, 611 bp, Homo sapiens
  misc_feature: GZ8MTXP01DU3MF.25.87.H10.1.454.CMB.2.raw
  modified_base (222)..(222): a, c, t, g, unknown or other
  modified_base (249)..(249): a, c, t, g, unknown or other
  modified_base (258)..(258): a, c, t, g, unknown or other
  modified_base (338)..(338): a, c, t, g, unknown or other
  modified_base (342)..(342): a, c, t, g, unknown or other
  modified_base (354)..(354): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattacgngggctggcnccgccacgccccgaggacggctggagtggatgcgtattgtctttcataggtgggatgtcctatacacgtccctcccctanaagngtcagtacactnttcgtgacacgtccacggcagctagttcgtctctgactacttgacgtcacgtccgacggccgccgaacgcgggtccttctaacgttaccgtgtccgacggtaaggacgttcgaacgggtcccgggttaaccggaaaaccccccttaccaaaccccgtttacgtttacggaaacccgtaaccgggttcgggggacccgttaacggggtaacccggttcggaaccctaacccggtcaacccgttcaaccgtaacccccg

SEQ ID NO: 425385 - DNA, 565 bp, Homo sapiens
  misc_feature: GZ8MTXP01AU9G2.25.87.H10.1.454.CMB.2.raw
  modified_base (259)..(259): a, c, t, g, unknown or other
  modified_base (358)..(358): a, c, t, g, unknown or other
  modified_base (366)..(366): a, c, t, g, unknown or other
  modified_base (442)..(442): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggcncgtcacgcccccgagggaggcctggagtggattgcgtattgtctttcatagtgggagtgcctacgtacacgtccctcccctcaagagtcgagtcacctntttcggtnacacgtccagcagcagttgtctctgacactgacgtctgtccacggcccgccgacgacggtccgtctacgttactgngcgagacgtcaggtccggtcggaaaccccctacaaccccctactttcgaacctacccggttcgggggcccaacgggggaacccgttcgggtccaacccggtccaacccttcgaacgtcccccg

SEQ ID NO: 425386 - DNA, 690 bp, Homo sapiens
  misc_feature: GZ8MTXP01DCU47.25.87.H10.1.454.CMB.2.raw
  modified_base (222)..(222): a, c, t, g, unknown or other
  modified_base (240)..(240): a, c, t, g, unknown or other
  modified_base (246)..(246): a, c, t, g, unknown or other
  modified_base (255)..(255): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattcgngggctggcnccgcacgccccgagggacggcctggagtgattgcgtattcgttcttcagtaggtgggagtcgaccttactacacgtcccctacccctacaaagcgtacgacgtcccaacttcgtttccggttacgaacctaccgaccacggacacgtcgttagttcgtacctcgtagtaacctacgtcgtacgttcgtcgtaccgaccgggtcccgacccgacggtacccgggtccttaacttatttaaccggtgtacggccgtaaaggcgttaccgaacgggtacccggttaaacccggtaaaaccccccttacttaaacccccgtttacgtttaccggaaaccctcccgggggttaccggggcccggaaaccgggggttaacccgtccggggtaaccccaccccggttaccggaaccccttccgaacccgggtaacccccccg

SEQ ID NO: 425387 - DNA, 604 bp, Homo sapiens
  misc_feature: GZ8MTXP01CTGUE.25.87.H10.1.454.CMB.2.raw
  modified_base (223)..(223): a, c, t, g, unknown or other
  modified_base (250)..(250): a, c, t, g, unknown or other
  modified_base (260)..(260): a, c, t, g, unknown or other
  modified_base (351)..(351): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcaccagtaatgctcattacnggggctggcnccgccacgcccccgagggaacggcctggagtggattgcgtattgtctttcagtagtgggagtgcctactacacgtccctccccctacaagngtacgacgtaccacctgtttcggttcgacctacgtccacgcaagtcctaggttctctctgtaccacttcgtacgtctcggtccaccggccgacccgacggaccggggtccttacgttattacgtgtgcgtagagtcacggtccggtacggaaaacccctcaaccccgtttacttcgaaccgtccggttcgggggacccttacggggtaacccgttcgggcctaacccggtccacccgttaaccgccgtccccc

SEQ ID NO: 425388 - DNA, 632 bp, Homo sapiens
  misc_feature: GZ8MTXP01BMULE.25.87.H10.1.454.CMB.2.raw
  modified_base (222)..(222): a, c, t, g, unknown or other
  modified_base (247)..(247): a, c, t, g, unknown or other
  modified_base (255)..(255): a, c, t, g, unknown or other
  modified_base (411)..(411): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacngggctgcncgcacgccccgaggaggctggagtggattgcgtattcgttcttcagtaggtgggtatcgtaccttactacgtacgtcccctacccctacgaagtagtcgagtaccctaccgtaagtttcggtacgactaccgtccacgccaagcctaggttctctnttcgactactgtactcgcgtcgaccggccgcccgtaacgccgggtcctacttaacgttcgtgcgcgaagtcgtccgaggtcccggtaaacgtaaaccccctaccgaaaccccgtttacgttacggaacccgttacccgggccggggacccgttaacgggggtaacccgtccgggtaaccctacccgggtcccttaaacccgttccgaaccggtaacccccg

SEQ ID NO: 425389 - DNA, 558 bp, Homo sapiens
  misc_feature: GZ8MTXP01ENOFK.25.87.H10.1.454.CMB.2.raw
  modified_base (221)..(221): a, c, t, g, unknown or other
  modified_base (422)..(422): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcagcccagggcaggtgaagccttcggagaccctgtccctcacctgctctgtctctggtnactcatcacagtatgctcattacgtgggctggctccgccagcccccgagggacggcctggagtggattgcgtattgtctttcataggtcgggagtgcctactcacgtcccctcccctcaagagtcgagtaccacctgtttcggtgaccacgtccacgcagctagttgtctctgactacgtgtacgtctcggtcaccggccncccggacgaccggcgttctactacgtgtagcgagtgtcgtacgcggtacggaaacccctacgttaacccctatttcgacctaccgttcggggccaggggtaacccgtcggtccaccgtcaccgtccgaacgtcccc

SEQ ID NO: 425390 - DNA, 620 bp, Homo sapiens
  misc_feature: GZ8MTXP01BOI36.25.87.H10.1.454.CMB.2.raw
  modified_base (222)..(222): a, c, t, g, unknown or other
  modified_base (241)..(241): a, c, t, g, unknown or other
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattacgngggctggctccgcacgccccgagggacggcctggagtggattgcgtatttcgtctttcagtaggtgggatgccttactacacgtcccctccctacaagcgtcgagtacctaacttgtttcgtacgacctaccgtaccacgcagtcctagttcgtctctacgactacgtcgtacgtcgtcgccgacggcccgccgacgaccggtccgttactacgttacgtggtcggacgtaaggtcgtacgacgggtaccggttaaacccggaaaaccccttaacccgttaaaccccgtttacgtttacgaaccgtacccggttcggggaccgaaccggggtaaccgtcggtaaccacccgtccgacctccgaacgtccccg

SEQ ID NO: 425391 - DNA, 535 bp, Homo sapiens
  misc_feature: GZ8MTXP01BP4JZ.25.87.H10.1.454.CMB.2.raw
  modified_base (222)..(222): a, c, t, g, unknown or other
  modified_base (249)..(249): a, c, t, g, unknown or other
  modified_base (365)..(365): a, c, t, g, unknown or other
  modified_base (402)..(402): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacngggctggctccgccagcccccagggaggcctggagtggattgcgattgtctttcatagtgggagtgcctactacagtccctccccctcaagagtcgagtcacctaatttcgggttnacacgtccacgcagcagttgtctctgacactggactntgtccacggccgccgacgacggccgtctattactgtcgcgagagtcagtccggtcggaaacccctacaaccccttacgttcgaccacgttcgggggccaggggaacctggtcaccgtcaccctcgaacgcccc

SEQ ID NO: 425392 - DNA, 508 bp, Homo sapiens
  misc_feature: GZ8MTXP01DIBH5.25.87.H10.1.454.CMB.2.raw
  modified_base (223)..(223): a, c, t, g, unknown or other
  modified_base (248)..(248): a, c, t, g, unknown or other
  modified_base (337)..(337): a, c, t, g, unknown or other
  modified_base (350)..(350): a, c, t, g, unknown or other
  modified_base (362)..(362): a, c, t, g, unknown or other
  modified_base (426)..(426): a, c, t, g, unknown or other
  modified_base (433)..(433): a, c, t, g, unknown or other
  modified_base (453)..(453): a, c, t, g, unknown or other
  modified_base (467)..(467): a, c, t, g, unknown or other
  modified_base (491)..(491): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnactcatcaccagtatgctcattacngggctggctccgccagcccccagggaggcctggagtggatgcgattgtctttcatagtgggatgcctactacagtccctcccctcaagngtcgagtcacctntttcggttgacncgtccacgcagcagttgtctctgacatgacgtctgtcacggccgccgacgacggcgtcattacngtgcganagtcagcggtgaaacccctnacccctattcgacncgttcgggccagggaacctggccncgtcacctcgaacgccc

SEQ ID NO: 425393 - DNA, 555 bp, Homo sapiens
  misc_feature: GZ8MTXP01DJQBM.25.87.H10.1.454.CMB.2.raw
  modified_base (222)..(222): a, c, t, g, unknown or other
  modified_base (249)..(249): a, c, t, g, unknown or other
  modified_base (258)..(258): a, c, t, g, unknown or other
  modified_base (348)..(348): a, c, t, g, unknown or other
  modified_base (410)..(410): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgngggctggcnccgccacgcccccgagggaggcctggagtggattgcgtattgtctttcagtaggtgggatcgcctactacacgtcccctcccctcaaagngtcgagtccactgtttcggtgacacgtccacgtcagctagttgtctctgacactgacgttcngtccacggccgccgacgaccggtccgtctagttacgtgtgcgagcgtcgaggccgtacggaaacccctacaaccccttacgttcgaccgtaccgttacggggccaacggggaaccgtcggtccaccggtcaccgtcgaacgcccc

SEQ ID NO: 425394 - DNA, 546 bp, Homo sapiens
  misc_feature: GZ8MTXP01BVFHZ.25.87.H10.1.454.CMB.2.raw
  modified_base (222)..(222): a, c, t, g, unknown or other
  modified_base (389)..(389): a, c, t, g, unknown or other
  modified_base (393)..(393): a, c, t, g, unknown or other
  modified_base (441)..(441): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccacgccccccgagggacggcctggagtggattgcgattgtctttcatagtgggagtgcctactacagtccctccccctacagagtcgagtcacctaatttcggttgacacgtccacgcagcagttntctntgacacttgacgtctgtcacgaccgccgacacggccgtcatttaccgngtgcgagcgtcgagtccggtaaccgaaacccctacaaccccttattacgacctacggttcggggccgaacgggaacccgtggtccacccgtccacctccgcgccg

SEQ ID NO: 425395 - DNA, 630 bp, Homo sapiens
  misc_feature: GZ8MTXP01EC2N2.25.87.H10.1.454.CMB.2.raw
  modified_base (225)..(225): a, c, t, g, unknown or other
  modified_base (252)..(252): a, c, t, g, unknown or other
  modified_base (262)..(262): a, c, t, g, unknown or other
  modified_base (362)..(362): a, c, t, g, unknown or other
  modified_base (379)..(379): a, c, t, g, unknown or other
  modified_base (381)..(382): a, c, t, g, unknown or other
  modified_base (384)..(384): a, c, t, g, unknown or other
  modified_base (402)..(402): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagcccttcggacgaccctgtcccctcacctgctctgtctctggtnactccatcacagtaatgcctcattacnggggctggcncccgccagccccccagggaagggcctggagtggattgcgattgtctttcatagtgggagtgcctactacagtccctccccctcaagagtccgagtcaccntttcggtgacacgcacncnncngtgtctcgttcgtactancctacgtacgtaccgttcgttcgtaccgggtacccggtccccggacccgaaccggacccggtcccgttacgttaacgttaccgtcggtcgtacgtacggtacgtaacgaacggttcgggtaaacccggttaaacccgtaaacccgtaaaccccttacgttaccgaccgtaaccgggtccggaaccggaaccgggtaccggttacggtaacccgttaaccggtaacccg

SEQ ID NO: 425396 - DNA, 617 bp, Homo sapiens
  misc_feature: GZ8MTXP01DTIGS.25.87.H10.1.454.CMB.2.raw
  modified_base (222)..(222): a, c, t, g, unknown or other
  modified_base (254)..(254): a, c, t, g, unknown or other
  modified_base (295)..(295): a, c, t, g, unknown or other
  modified_base (471)..(471): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcatcgtgggctggcnccgcacgcccgagggaggctggagtgatgcgtattgtcttnagtagtgggatcgccttactaccacgtccccctcccctacgaaagtcgtaccgacgtacccaccttaagtttcgggttacgacctaccgtccaacgctacggtctagtttcgtctacgtcgactacgtgacgtctcgccgaaccggccgaccgacaccggtcttactagtacgtgngccgaaagcgttacacggtaccggtaacgtaaaaccccctcgttaaaccccgtttgttacgaaccgtaccggttacgggggacccaacgggggtaacccgttgggtaaccccacccggtcaacccggttcaacccggtaacccccg

SEQ ID NO: 425397 - DNA, 640 bp, Homo sapiens
  misc_feature: GZ8MTXP01AQCWR.25.87.H10.1.454.CMB.2.raw
  modified_base (221)..(221): a, c, t, g, unknown or other
  modified_base (254)..(254): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactccatcacagtatgctcatcgtgggctggcnccgccacgccccgagggacggcctggagtggattgcgtattgtcttcagtaggtgggagtcgcctactacacgtcccctcccctacagagtcgagtaccacctgtttcggtagaccaccgtccacgcagctagttcgtctctagactacgtgaccgttctcggtccaccgggcccgaccgaccgggaccggtcccgttacttaacgttccgtggtacgccggtaaggtacgttccgacggtcccgggtaacccggaaaaccccccttacgttaaacccccgtttacgtttcggaaaccccgtacccgggttcgggggaccccaacgggggtaaccccggttcggtaaccccgtacccggtccaccccgtcgaacccggtaaccccc

SEQ ID NO: 425398 - DNA, 567 bp, Homo sapiens
  misc_feature: GZ8MTXP01C8PTE.25.87.H10.1.454.CMB.2.raw
  modified_base (247)..(247): a, c, t, g, unknown or other
  modified_base (305)..(305): a, c, t, g, unknown or other
  modified_base (365)..(365): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcacagtatgctcattacgnggggctggctccgccacgccccgagggacggcctggagtggattgcgtattgtctttnagtagtgggatgcctactacacgtcccctcccctacaagagtcgagtcactgtttcggtnacacgtccacgcagctagttgtctctgacactgacgtctgtccacggccgccgacgaccggtccgtctattacgtgtgcgagtcgtcgaggtccggtacgaaaaccccctacgaaacccccttagttcgaacccgtaccggttcgggggacccacggggtaacccgtcggtccaacccggtcaacccttcgaaccggtcccc

SEQ ID NO: 425399 - DNA, 585 bp, Homo sapiens
  misc_feature: GZ8MTXP01DBJA1.25.87.H10.1.454.CMB.2.raw
  modified_base (204)..(204): a, c, t, g, unknown or other
  modified_base (223)..(223): a, c, t, g, unknown or other
  modified_base (255)..(255): a, c, t, g, unknown or other
  modified_base (329)..(329): a, c, t, g, unknown or other
  modified_base (418)..(418): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctnacctgctctgtctctggtnactccatcacagtatgctcatctgggctggcnccgcacgccccgaggacggcctggagtggatgcgtattcgttctttcagtaggtgggtagtcgtcctaactacncgtcccctcccctacgaaagtcgtcgacgtacctaccctaagtttcgggtacgaacctaccggtccacggcaaggcttaggttctctcngtacacgttgacgtctcgccacggcccgccgaacgccgggtcctctaagtcgtgtagcgagtcgtcgaggtccggtaaccgtaaacccctacgttaaccccttagttcgaaccgtcgttcggggccacggggtaacctcggtccaccgtcaccgtccgcgaaccccg

SEQ ID NO: 425400 - DNA, 541 bp, Homo sapiens
  misc_feature: GZ8MTXP01D2C92.25.87.H10.1.454.CMB.2.raw
  modified_base (223)..(223): a, c, t, g, unknown or other
  modified_base (259)..(259): a, c, t, g, unknown or other
  modified_base (353)..(353): a, c, t, g, unknown or other
  modified_base (367)..(367): a, c, t, g, unknown or other
  modified_base (454)..(454): a, c, t, g, unknown or other
  modified_base (523)..(523): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtaatgctcattacgtgggctggcnccgccagcccccgagggaagggcctggagtggattgcgtattgtctttcattaggtgggagtgccttaactacacgtcccctccccctacaagngtcgagtccacctntttcgtgaccacgtccacgcagcagttgtctctgacactgacgtctgtcacggccgccgacgaccggcgttctattactgtgcgagngtcagcggtacgaaacccctacttaacccctacttcgacaccgttcggggccacgggaaccgtggtccnccgtcacctcaacgcccc

SEQ ID NO: 425401 - DNA, 569 bp, Homo sapiens
  misc_feature: GZ8MTXP01C8U6C.25.87.H10.1.454.CMB.2.raw
  modified_base (222)..(222): a, c, t, g, unknown or other
  modified_base (253)..(253): a, c, t, g, unknown or other
  modified_base (256)..(256): a, c, t, g, unknown or other
  modified_base (272)..(272): a, c, t, g, unknown or other
  modified_base (333)..(333): a, c, t, g, unknown or other
  modified_base (337)..(337): a, c, t, g, unknown or other
  modified_base (363)..(363): a, c, t, g, unknown or other
  modified_base (383)..(383): a, c, t, g, unknown or other
  modified_base (386)..(387): a, c, t, g, unknown or other
  modified_base (398)..(398): a, c, t, g, unknown or other
  modified_base (437)..(437): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcatcgtgggctgcnccncacgcccgaggaggcnggatggatgcgtattgtctttcagtagtgggagtgacctactacacgtccccttcccccanaagngtcgagtacaccctaatttcgggtanacacgtccacgcagcagttnctnnacactgactcncgccacggccgaccgtacggacggtccctatatacctgngcgagagtcgacgacgaccgggtaaaccctaacccaacccctaccttacgtaccgtaccgttacggggccggacggggtaaccgggttacggtcccgtacccggtacccttacctaaccgccgtaacccccg

SEQ ID NO: 425402 - DNA, 714 bp, Homo sapiens
  misc_feature: GZ8MTXP01D0AB4.25.87.H10.1.454.CMB.2.raw
  modified_base (222)..(222): a, c, t, g, unknown or other
  modified_base (240)..(240): a, c, t, g, unknown or other
  modified_base (246)..(246): a, c, t, g, unknown or other
  modified_base (255)..(255): a, c, t, g, unknown or other
  modified_base (303)..(303): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattcgngggctggcnccgccacgccccgagggacggcctggagtggatgcgtattgttctttnataggtgggagtgcctactacacgtcccctcccctacaaggagtccgacgtaccaaccgtaagttttccgggttacgacccgtaaccggtccccaacggcgtaacgtcccgtaaggtttccgttccttaccgttacggaacccttaaccgttcggtaaccgtttccggtcggttacccgaacccggggccccgacccgggaaccggtaccggggtccccgttacgttaactttaccgtgtcggacggtaaggtacgtcgaacgggtccgggttaaccggaaaacccccttaacgttaaacccccgtttacgtttacgaacccgtacccggttacgggggaccccgaaacgggggtaacccgtcggggttaaccccaaccggtaccttacccttccgaaccggtaacccccg

SEQ ID NO: 425403 - DNA, 553 bp, Homo sapiens
  misc_feature: GZ8MTXP01A2RCS.25.87.H10.1.454.CMB.2.raw
  modified_base (222)..(222): a, c, t, g, unknown or other
  modified_base (360)..(360): a, c, t, g, unknown or other
  modified_base (543)..(543): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattactggggctggctccgccacgcccccgagggaagggcctggagtggattgcgtattgtctttcagtaggtgggagtgcctactacacgtcccctcccctcaagagtcgagtcactntttcggtgacacgtccacgcagctagttgtctctgacactgacgtctgtccgacggccgccgacgacgggccgtccagtttactgtcgcgagcgtcgtagcggtacgaaacccctacgacccctacgtttcgaccgtccgttcggggccaacggggtaacccgttggccaccggtcaccgtcncgtaaccccg

SEQ ID NO: 425404 - DNA, 616 bp, Homo sapiens
  misc_feature: GZ8MTXP01DR1ZW.25.87.H10.1.454.CMB.2.raw
  modified_base (203)..(203): a, c, t, g, unknown or other
  modified_base (222)..(222): a, c, t, g, unknown or other
  modified_base (251)..(251): a, c, t, g, unknown or other
  modified_base (261)..(261): a, c, t, g, unknown or other
  modified_base (308)..(308): a, c, t, g, unknown or other
  modified_base (332)..(332): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactccatcacctagtaatgctcattacgnggggctggcnccgcacgccccgagggacggctggagtggatgcgtattcgttcttanagttaggtgggatgacctactacncgtcccctcccctacaagcgtcgacgtacaccttaagtttcggtacgaccaccgtccaacgcagctaggttctctctagactagtcgtacgtctcgccgacggcccgaccgttaacggcccgggtccttataacttccgtggcgacggtacgagtcgacggtcggtaacccggaaaacccctcttaaacccccgttatttacggaaacccgtccgggttacggggcccgaaacggggtaacccgttcgtaacccgacccggttcacccgttcaacccggtcccc

SEQ ID NO: 425405 - DNA, 552 bp, Homo sapiens
  misc_feature: GZ8MTXP01DNWW4.25.87.H10.1.454.CMB.2.raw
  modified_base (222)..(222): a, c, t, g, unknown or other
  modified_base (441)..(441): a, c, t, g, unknown or other
  modified_base (458)..(458): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattactggggctggctccgccacgcccccgagggaagggcctggagtggattgcgtattgtctttcatagtgggagtgcctactacacgtcccctcccctcaagagtcgagtccacctaagtttcggttgaccacgtccacggtcagctagttgtctctgacactgacgtctgtccacggcccgccgacgacggtccgtntattaccgtgtgcgagngtcaggccggtacggaaacccctcaaccccttacgttcgaccgtaccgttggggccacgggaaccgtggtaaccaccgtcacctcgcgtccccg

SEQ ID NO: 425406 - DNA, 561 bp, Homo sapiens
  misc_feature: GZ8MTXP01DXDOR.25.87.H10.1.454.CMB.2.raw
  modified_base (222)..(222): a, c, t, g, unknown or other
  modified_base (246)..(246): a, c, t, g, unknown or other
  modified_base (344)..(344): a, c, t, g, unknown or other
  modified_base (454)..(454): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacngggctggctccgcacgccccgagggacggcctggagtggattgcgtattgtctttcataggtgggagtcgcctactacacgtccctaccccctcaagngtcgacgtaccactaagtttcggtagaccacgtccacgcagctagttctctctgactacgttgacgtctgccgacggccgccgacgacggcctacttatactgtgcgagngtcgacgcggtaacgaaacccctacaaccccttagttcgaaccgtaccgttggggcccaacggggtaaccgtcggtcccaacccgtcaacccgtcaaccggtccccg

SEQ ID NO: 425407 - DNA, 572 bp, Homo sapiens
  misc_feature: GZ8MTXP01D4HTU.25.87.H10.1.454.CMB.2.raw
  modified_base (222)..(222): a, c, t, g, unknown or other
  modified_base (236)..(236): a, c, t, g, unknown or other
  modified_base (240)..(240): a, c, t, g, unknown or other
  modified_base (247)..(247): a, c, t, g, unknown or other
  modified_base (255)..(255): a, c, t, g, unknown or other
  modified_base (309)..(309): a, c, t, g, unknown or other
  modified_base (454)..(454): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtangctnattacgngggctgcnccgcacgcccgaggacggctggagtgatgcgattgtcttcagtaggtggagtcncctactacacgtcccctccctacgagagtcgacgtaccaccttgttcggttacgactaccgtccacgcacgtactgtttcgtctctcgactacttgacgtctcgcgaccggccgacccgacggacgggtccctcttaacgttcgngtcgacgagcgtcgacggtccggtaaccaaacccttaccgttacccttacgttcgaccgtccggttcgggaccgacgggtaaccgtcgtaaccgtacccgtccgacctcgccgtcccg

SEQ ID NO: 425408 - DNA, 628 bp, Homo sapiens
  misc_feature: GZ8MTXP01EMDW7.25.87.H10.1.454.CMB.2.raw
  modified_base (221)..(221): a, c, t, g, unknown or other
  modified_base (368)..(368): a, c, t, g, unknown or other
  modified_base (372)..(372): a, c, t, g, unknown or other
  modified_base (410)..(410): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagccagggcaggtgaagccttcggagaccctgtccctcacctgctctgtctctggtnactccatcacagtaatgctcattacgtggggctggctccgccacgcccccgagggaacggcctggagtggatgcgtattgtctttcagtagtggatgcctactactacttccctcctacaagagtcgacgtccaactatttcgggtnaacncgtccacgcagcctagttgctcgtgacagtcgacgttncgtacgaccgccgaccgacaccgggggcttacttacgttactggtcgaccggaagacggtcaacgggtacccggttaacccggaaaaccccccttaacgtaaacccccccttagtttcggaaacccgtacccgggtcgggggaccttacgggggttaaaccccgtcggggtacctaaccccgggttcacccgttccgaaccgttccccgtaaccccgg

SEQ ID NO: 425409 - DNA, 619 bp, Homo sapiens
  misc_feature: GZ8MTXP01CK4N2.25.87.H10.1.454.CMB.2.raw
  modified_base (223)..(223): a, c, t, g, unknown or other
  modified_base (247)..(247): a, c, t, g, unknown or other
  modified_base (256)..(256): a, c, t, g, unknown or other
  modified_base (345)..(345): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactcatcacagtatgctcattcgngggctggcnccgccacgccccgagggacggcctggagtggattgcgtattgtctttcagtaggtgggagtcgacctactacacgttcccctcccctanaagcgtcgacgtacctacctgtttcggttacgacctacgtccacgcagtcctagtttcgtctctagacctatcggtacgtcgtcgcccgacggcccgacccgaacggtccgggtaccgttcttacgttaccgtggtcgacggtagacgtcgacggcggttacccggaaaaccccctcgttaaaccccttacttcggaaacccgtcgggttcgggggcccttacgggggaaccctcggtaacccgacccgttcccgaacctccgaaccgtccccg

SEQ ID NO: 425410 - DNA, 580 bp, Homo sapiens
  misc_feature: GZ8MTXP01CYWFP.25.87.H10.1.454.CMB.2.raw
  modified_base (224)..(224): a, c, t, g, unknown or other
  modified_base (260)..(260): a, c, t, g, unknown or other
  modified_base (307)..(307): a, c, t, g, unknown or other
  modified_base (347)..(347): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccaggggcaggtgaagccttcggagaccctgtcccctcacctgctctgtctctggtnactccatcaccagtatgctcattacgtgggctggcnccgccacgccccgaagggacggcctggagtggatgcgattgtctttnatggtgggagtgacctactacacgtcccctcccctcaagngtcgagtccaacctgtttcggttagacctacgtccacgtcagctagttgtctctgacactgacgtctgcaccggcccgccgacgaccggccgttactattaccgtggngtcgagcgtcgacggccggttaacgaaaacccccttcaaaccccgtttcttacggaaccctcccggttacggggcccaacggggtaacctcgggtcctaccccggcacccgtcgaaccggtcccc

SEQ ID NO: 425411 - DNA, 643 bp, Homo sapiens
  misc_feature: GZ8MTXP01EIQ8P.25.87.H10.1.454.CMB.2.raw
  modified_base (223)..(223): a, c, t, g, unknown or other
  modified_base (249)..(249): a, c, t, g, unknown or other
  modified_base (259)..(259): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctcattacgnggggctggcnccgcacgccccgagggacggcctggagtggattgcgtatttgtctttcagtaggtgggatcgccttacacacgtcccctacccctcaagagtcgacgtaccaacctgtttcggtacgaccacgtccaacgcacgctagttcgtctctgactacgtgacgtctgccgacggccgccgacggacgggtccttactacgttacgtcggtcggcggaaagtcgggtacctagggtccccgggttaacccggaaaaaccccccttaccggttaaacccccctttacgttttacggaacccgtacccgggttcgggggacccgttaaacgggggtaaccccggtttggaacccctacccgggtacccacccttccgaaccggtccccccg

SEQ ID NO: 425412 - DNA, 654 bp, Homo sapiens
  misc_feature: GZ8MTXP01C9V4E.25.87.H10.1.454.CMB.2.raw
  modified_base (203)..(203): a, c, t, g, unknown or other
  modified_base (222)..(222): a, c, t, g, unknown or other
  modified_base (241)..(241): a, c, t, g, unknown or other
  modified_base (248)..(248): a, c, t, g, unknown or other
  modified_base (258)..(258): a, c, t, g, unknown or other
  modified_base (344)..(344): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactcatcaccagtatgctnattacgngggctcggcnccgcacgccccgagggaggcctggagtggatgcgtattgtctttcagtaggtgggatcgcttactacacgtcccctccctacaagngtcgagtcccaccttgtttcgggtacgaacctcggtcccacgcacgtctaggtttctctcgtggaaccctacgttcggacgttcctacggacgaaccgggcccgacccgtaccggtacccgggtcccgttacttaacgttaccgtggttacgcggtaacggtacgtccgacgggtacccggttaaccgggtaaaacccccctacttaaacccccgtttatttaccgaaaccgtcccgttagggggacccaagggggtaacccgtgggttaaccccacccggtcccttaccgttaaccgcgttaacccccg

SEQ ID NO: 425413 - DNA, 587 bp, Homo sapiens
  misc_feature: GZ8MTXP01CUYLX.25.87.H10.1.454.CMB.2.raw
  modified_base (222)..(222): a, c, t, g, unknown or other
  modified_base (449)..(449): a, c, t, g, unknown or other
  modified_base (458)..(458): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccacgcccccgagggaacgggcctggagtggattgcgtattgtctttcagtagtgggagtgcctactacacgtcccctcccctcaagagtcgagtcactgtttcgtgacacgtccacgcagctagttcgtctctgacacgtgacgtctgtccacggcccgccgacggaccgggccgttctaattccngtcgcgagngtcgacggccggtacggaaacccctacgaaccccttacgttacgaacccgccgttcgggggcccttaacgggggaacccgttcgggttaacccgaacccggtttccacccgttccgaaccggtcccccg

SEQ ID NO: 425414 - DNA, 611 bp, Homo sapiens
  misc_feature: GZ8MTXP01DGGEH.25.87.H10.1.454.CMB.2.raw
  modified_base (222)..(222): a, c, t, g, unknown or other
  modified_base (240)..(240): a, c, t, g, unknown or other
  modified_base (247)..(247): a, c, t, g, unknown or other
  modified_base (256)..(256): a, c, t, g, unknown or other
  modified_base (302)..(302): a, c, t, g, unknown or other
  modified_base (340)..(340): a, c, t, g, unknown or other
  modified_base (366)..(366): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattacgngggctggcnccgccacgccccgagggacggctggagtggatgcgtattgtctttnagtaggtgggatcgccttactacacgtccctcccctanaagcgtcgagtccacctgtttcggtnaccaccgtccacgcagtctagttcgtctcgtacgactactcggtacgttctcggaccgaccgggcccgacccggacggtaccgggtccgttacttaagttccgtggtcggacgtaggtacgtccgacggtacccgggtaaccggaaacccccttacgttaacccccgtttagttcgacccgtaccggttcggggaccgttaacggggtaaccgttcgtccgacccgtcacctccgaacgtccccg

SEQ ID NO: 425415 - DNA, 632 bp, Homo sapiens
  misc_feature: GZ8MTXP01A27B3.25.87.H10.1.454.CMB.2.raw
  modified_base (223)..(223): a, c, t, g, unknown or other
  modified_base (257)..(257): a, c, t, g, unknown or other
  modified_base (346)..(346): a, c, t, g, unknown or other
  modified_base (360)..(360): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctcattactgggctggcnccgccacgccccgagggaggcctggagtggattgcgtattgtctttcgataggtgggagtgccttaacacacgtcccctcccctcaagngtcagtaccacctntttcggtgacctacgtccacgcagctagttcgctctgactactgacgtcacgtcgaccggccgacccgacgacccgggtccgttactaacgtttaccgtggttacgaccggaaggtacggttccgaacgggtcccggggttaacccgggaaaaaccccctttaccgaaaaccccccctttgtttacgaaacccgtcccggttacgggggcccaaaccgggggtaaccgtccggtaaccgtacccggtcaccccgttcgaaccggtaaccccc

SEQ ID NO: 425416 - DNA, 643 bp, Homo sapiens
  misc_feature: GZ8MTXP01DL9DZ.25.87.H10.1.454.CMB.2.raw
  modified_base (222)..(222): a, c, t, g, unknown or other
  modified_base (257)..(257): a, c, t, g, unknown or other
  modified_base (332)..(332): a, c, t, g, unknown or other
  modified_base (351)..(351): a, c, t, g, unknown or other
  modified_base (399)..(399): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtaatgctcattacgtgggctggcnccgcacgcccccgagggaaggcctggagtggattgcgtattggtctttcagttaggtgggtatcgccttactacncgtcccctcccctacaagngtcgagtccaacctgtttcgtgaccacgtccacgtcagctagttgctntgacagtcgtacgtctgtcacggccgccgaacgtccggtccgttactaacgtttccgtgtcgtacggaactacggttccgacgggtaccccgggttaaccggaaaaaacccccccttacgttaaaacccccgtttacgttttacggaaccccgtaccgggttaccggggggaccccttaaacgggggtaaccccggttcggttaacccaacccgggttcaaccccttcgaaccggtaacccccg

SEQ ID NO: 425417 - DNA, 644 bp, Homo sapiens
  misc_feature: GZ8MTXP01DIF6U.25.87.H10.1.454.CMB.2.raw
  modified_base (222)..(222): a, c, t, g, unknown or other
  modified_base (247)..(247): a, c, t, g, unknown or other
  modified_base (256)..(256): a, c, t, g, unknown or other
  modified_base (338)..(338): a, c, t, g, unknown or other
  modified_base (369)..(369): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacnggggctgcncgccacgccccgaggaggctggagtggatgcgtattgtctttcagtaggtgggagtcgcctactacacgtcccctccccctnaagtgtcgacgtcaaccgtgtttcgggttanacacgtcccacgcacgtctagtttcgctctagactaacgtcgtacgtcgtcgcccaaccgggtcccgacccgaacggacccggtcccggttattaacttccgtggtccgcggttaagacgtcgacgggtccgggtaaaccggaaaaccccccttacttaaaccccccgtttagtttccggaaaccgtaccccggttgggggaccccgacgggggtaaacccggttcggttaaccccgaaaccccggttcaaccccgttccgaaaccggtcccccg

SEQ ID NO: 425418 - DNA, 553 bp, Homo sapiens
  misc_feature: GZ8MTXP01EXC1L.25.87.H10.1.454.CMB.2.raw
  modified_base (203)..(203): a, c, t, g, unknown or other
  modified_base (222)..(222): a, c, t, g, unknown or other
  modified_base (240)..(240): a, c, t, g, unknown or other
  modified_base (245)..(245): a, c, t, g, unknown or other
  modified_base (253)..(253): a, c, t, g, unknown or other
  modified_base (290)..(290): a, c, t, g, unknown or other
  modified_base (374)..(374): a, c, t, g, unknown or other
  modified_base (434)..(434): a, c, t, g, unknown or other
  modified_base (443)..(443): a, c, t, g, unknown or other
  modified_base (480)..(480): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactcatcacagtatgctnatacngggctgcncgcacgcccaggaggctggagtgatgcattgtcttanagtagtgggatcgcctatacacgtccctcccctacaagacgtcgacgtaaccacctgtttcggtacgaccacgtccacgcacgntagttcgtctctgactactgacgtctacgcacggccgccgacgacggtcgtctagttacngtgcgagtntcgacgccggtaacgaaacccctacttaaaccccgtntttacggacctacggttcggggcccacggggtaaccgtcgtaacccgaccggtcaccctcgaaccggtccccg

SEQ ID NO: 425419 - DNA, 601 bp, Homo sapiens
  misc_feature: GZ8MTXP01CCJQB.25.87.H10.1.454.CMB.2.raw
  modified_base (221)..(221): a, c, t, g, unknown or other
  modified_base (350)..(350): a, c, t, g, unknown or other
  modified_base (363)..(363): a, c, t, g, unknown or other
  modified_base (374)..(374): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcaccagtatgctcattacgtggggctggctccgccacgcccccgagggaagggcctggagtggattggcgtattgtctttcagtagtgggagtcgccttactacacgtccctccccctcaagngtcgagtcacctntttcggtgacncgtccacgcacgctagttgctctgactacgtgacgtctggtccaccggccgtcccgacgacggtccgttactactttacgngttggccgaggtcgtccgaggccggtaaccggaaaacccccttacttaacccccgttcgtttacgaaccctaccggttcgggggaccccttacgggggaaccccgttcgggaaccacccggtaccaccttccgaacgtaacccccg

SEQ ID NO: 425420 - DNA, 641 bp, Homo sapiens
  misc_feature: GZ8MTXP01DYYDJ.25.87.H10.1.454.CMB.2.raw
  modified_base (203)..(203): a, c, t, g, unknown or other
  modified_base (221)..(221): a, c, t, g, unknown or other
  modified_base (245)..(245): a, c, t, g, unknown or other
  modified_base (254)..(254): a, c, t, g, unknown or other
  modified_base (299)..(299): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctgtnactcatcacagtatgctcatacgngggctggcnccgccacgccccgagggacggcctggagtggatgctattgtcttnagtaggtgggatgcctactacacgtcccctcccctacaagcgtcgacgtaccacctaagtttcggtagacctaccgtccgacgcaacgtctaggttctctctgaactacgttgacgtcgtacgtccgaaccgggcccgacccgaccgtaacgggtcccgttacttacgttaccgtggtcgacggtagcgttacgacggtccgggtaacccggaaaacccccttaccaaaccccgtttacgtttacggaaacccgtacccgggttccgggggaccttaaaccgggggtaacccgttcgggtaaccctaccccggttaccacccttccgaaccgggtccccccg

SEQ ID NO: 425421 - DNA, 587 bp, Homo sapiens
  misc_feature: GZ8MTXP01DHKG3.25.87.H10.1.454.CMB.2.raw
  modified_base (258)..(258): a, c, t, g, unknown or other
  modified_base (301)..(301): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgccagatgggtcctgtcccagctgcgtctgcaggagtcgagcccagggcaggtgaagccttcggagaccctgtccctcacctgctctgtctctggtcactccatcactagtaatgctcattacgtgggctggcnccgcacgccccgaggacggctggagtgatgcgtattgtctttnagtaggtgggatcgacctactactcgtcccctacccctacgaaagtcgtacgaagtaccctaaccttaagtttcggtagaccgtaccgtccacgcagtactgttgctctagaccagtcgacgtctcgtccgaacggcccgaccgacggccggtcgttactacttacgtgtcgacggagacgtcgacggtaccggttacgaaaacccccttaccgaaaccccttattccgaacctaccggttcggggccaacgggaaccgtcggtcacccgcacctcgcgtaacccc

SEQ ID NO: 425422 - DNA, 629 bp, Homo sapiens
  misc_feature: GZ8MTXP01DJ5QU.25.87.H10.1.454.CMB.2.raw
  modified_base (222)..(222): a, c, t, g, unknown or other
  modified_base (247)..(247): a, c, t, g, unknown or other
  modified_base (257)..(257): a, c, t, g, unknown or other
  modified_base (303)..(303): a, c, t, g, unknown or other
  modified_base (346)..(346): a, c, t, g, unknown or other
  modified_base (372)..(372): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagctttcggagaccctgtccctcacctgctctgtctctggtnactccatcacagtatgctcattcgnggggctggcnccgccacgccccgagggacggctggagtggatgcgtattgtctttnagtggtgggatcgaccttactacacgtcccctcccctacaagngtacgagtaccactaagtttcgggtnacctaccgtccacgtcagctagttgtctctgactactgacgtctcggccgaccggccgcccgaacggtaccggggtcccttacttaagttccgtggtcgcggaaagtcgtacgaacgggccggttaaccggaaaacccccttacgttaaccccctttacgttacgaacccgtcccgggttacgggggcccttaaacgggggtaaccccgttacggtcccgtaaccccggtccttaacccgttccgaaccggtccccc

SEQ ID NO: 425423 - DNA, 537 bp, Homo sapiens
  misc_feature: GZ8MTXP01DZU8O.25.87.H10.1.454.CMB.2.raw
  modified_base (203)..(203): a, c, t, g, unknown or other
  modified_base (222)..(222): a, c, t, g, unknown or other
  modified_base (257)..(257): a, c, t, g, unknown or other
  modified_base (342)..(342): a, c, t, g, unknown or other
  modified_base (443)..(443): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactcatcacagtaatgctcattactggggctggcnccgccagcccccgagggaggcctggagtggattgcgattgtctttcagtagtgggatgcctactacacgtcccctcccctcaagngtcgagtccacctgttcgttgacacgtccacgctagctagttcgtctctgacacgtgacgtctgtacacggcccgaccgacgacgggccctactacttacngtgacgagacgtcagcggtacgaaacccctacaccccgtacttcgacaccgttgggccttagggaaccgtggtccaccgtcacctcaacgcccc

SEQ ID NO: 425424 - DNA, 660 bp, Homo sapiens
  misc_feature: GZ8MTXP01CKU51.25.87.H10.1.454.CMB.2.raw
  modified_base (217)..(217): a, c, t, g, unknown or other
  modified_base (222)..(222): a, c, t, g, unknown or other
  modified_base (370)..(370): a, c, t, g, unknown or other
tcagactgtacagtcacgaccggtgctcgatttagcagtactgcgttgggtttgggctcaactctcttgacctcctttgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctntggtnactccatcacagtaatgctcatcgtgggctggctccgccacgccccgagggacggcctggagtggatgcgtatttgtctttcagtgtgggagtcgcctactacacgtccctcctacagagtcgacgtcaacctagtttcggtcgaccncgtccacgtcagctagttcgtctcgtgacctcgtacgtaccgttcgtcgtcccgaccgggcccgacccggaccgaccgggggtcccgttacgttacgtttaccgtggtcggcggagtacgggtccgaacgggtacccgggttaacccggaaaaccccccttaacctaaacccccgttacgtttaccggacccgtaaacccgggtcgggggttaaccccgacgggggttaacccgtcgggtacccgtaacccggttcccaccgttcccgaacccgttccccgtaaccccgg

SEQ ID NO: 425425 - DNA, 608 bp, Homo sapiens
  misc_feature: GZ8MTXP01ELCAD.25.87.H10.1.454.CMB.2.raw
  modified_base (223)..(223): a, c, t, g, unknown or other
  modified_base (484)..(484): a, c, t, g, unknown or other
tcagactgtacagtcacgaccggtgctcgatttagcagtactgcgttgggtttgggctcaactctcttgacctcctgtgcaagaacatgaagcacatgtggttcttcctcctgctggtggcggcgcccagatgggtcctgtcccagctgcgtctgcaggagtcgagcccaggggcaggtgaagccttcggagaccctgtccctcacctgctctgtctctggtnactcatcaccagtaatgctcattacgtggggctggctccgccacgccccgagggacggcctggagtggattgcgtattgttctttcgagtaggtgggagtgtccctactacacgtcccccctccctacaagacgtcgaacgtcaaccgtatttcgggtcacaccgtccacgcagctagttgtctcttagactacgttgaccgttcgtcgccgaaccgggccccgacccgggaccaaccggggtcccttacctatttaccgnggtgaccgtagacgttcgacggtccggtaacggaaacccccttaccgaaacccctttagttccgaaccgacccgttggggacccctaagggtacccgtcgtcaccgttccaaccgttcaacccg

SEQ ID NO: 425426 - DNA, 609 bp, Homo sapiens
  misc_feature: GZ8MTXP01D5KCQ.25.87.H10.1.454.CMB.2.raw
  modified_base (191)..(191): a, c, t, g, unknown or other
  modified_base (203)..(203): a, c, t, g, unknown or other
  modified_base (222)..(222): a, c, t, g, unknown or other
  modified_base (237)..(237): a, c, t, g, unknown or other
  modified_base (241)..(241): a, c, t, g, unknown or other
  modified_base (248)..(248): a, c, t, g, unknown or other
  modified_base (257)..(257): a, c, t, g, unknown or other
  modified_base (324)..(324): a, c, t, g, unknown or other
  modified_base (339)..(339): a, c, t, g, unknown or other
  modified_base (367)..(367): a, c, t, g, unknown or other
  modified_base (390)..(390): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctnacctgctctgtctctggtnactccatcacagtangctnattacgngggctggcnccgcacgcccgagggacggctggagtgatgcgtattgtcttgagttaggtgggatcgccttactacncgtcccctcccctanaagtcgtcgagtaccacttgttcggtanaccacgtccacgcagtctagttnctctgactactcgtacgtctcgaccgaccgggccgacccgacgggtacccggtccgttacttacgttaccgtggtcgacgtagtcgtcgaccgggtaccggtaacccggtaaaacccctcttaaacccccgttagttccggaacccgtaccgggttacgggggccttaacgggggtaaccccgtggtaaccccaccgtccaccctcgaacccgtccccg

SEQ ID NO: 425427 - DNA, 599 bp, Homo sapiens
  misc_feature: GZ8MTXP01A4VEG.25.87.H10.1.454.CMB.2.raw
  modified_base (222)..(222): a, c, t, g, unknown or other
  modified_base (240)..(240): a, c, t, g, unknown or other
  modified_base (246)..(246): a, c, t, g, unknown or other
  modified_base (463)..(463): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattcgngggctggctccgccacgcccccgagggacggcctggagtggattgcgtattgtctttcagtaggtgggagtcgccttactacgacgtcccctcccctcaagagtcgagtaccacctgtttcggtacgactaccgtccaacgcagcctagttgtctctcggactactcgacgtcgttgccgaccggccgcccgacggaccggtccgtactagttacgngttcgcgagtcgtcgacggtaccggtaccggaaacccctacgttaacccctactttcggaacctccgggttcggggacccttacgggggaacccgtcggtaacctcccgggtccaaccgtcgaaccggtaaccccg

SEQ ID NO: 425428 - DNA, 572 bp, Homo sapiens
  misc_feature: GZ8MTXP01BGHY0.25.87.H10.1.454.CMB.2.raw
  modified_base (191)..(191): a, c, t, g, unknown or other
  modified_base (221)..(221): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctgtnactcatcacagtatgctcattactggggctggctccgccacgccccccgagggaacgggcctggagtggattgcgtattgtctttcagtagtgggagtgccttactacacgtccctccccctcgaagacgtcgagtccacctaagtttcggttgacctacgtccacgcagctagttgtctctgacacgtgaccgtctcgtaccgaccggcccgcccgacgtacccgggtccgtcttacgttactggtgccgagcgtcgagtccggtacggaaacccctacttaacccctacttcgaccgtaccgttcggggccacggggaaccgtggtccaccggtcacctcgaacgtccc

SEQ ID NO: 425429 - DNA, 639 bp, Homo sapiens
  misc_feature: GZ8MTXP01BTCBI.25.87.H10.1.454.CMB.2.raw
  modified_base (203)..(203): a, c, t, g, unknown or other
  modified_base (222)..(222): a, c, t, g, unknown or other
  modified_base (238)..(238): a, c, t, g, unknown or other
  modified_base (242)..(242): a, c, t, g, unknown or other
  modified_base (249)..(249): a, c, t, g, unknown or other
  modified_base (258)..(258): a, c, t, g, unknown or other
  modified_base (307)..(307): a, c, t, g, unknown or other
  modified_base (348)..(348): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactccatcaccagtangctnattacgngggctggcnccgccacggcccccgagggacggcctggagtggatgcgtattgtcttanagtaggtgggagtcgacctactacacgtcccctccccctanaagacgtcgacgtaccaacctgtttcgttacgactaccgtccaacgctagcctagttcgctcgttacgactacgtgacgttcgcggtacccaccgggccgacccgtaacggaccggggtcccgttactacgtttaccggtggtcgacgtaggtacgtacggacggtacccgggtaaacccgtaaacccctaacccgttaaacccgttacgttaccgaccgtaccgggttcggggaccgaacgggtaacccgtcgtaacccgaccgtccgacccgtccgttcccgtaacccg

SEQ ID NO: 425430 - DNA, 652 bp, Homo sapiens
  misc_feature: GZ8MTXP01AZ6YL.25.87.H10.1.454.CMB.2.raw
  modified_base (222)..(222): a, c, t, g, unknown or other
  modified_base (257)..(257): a, c, t, g, unknown or other
  modified_base (396)..(396): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgtgggctggcnccgcacgccccgagggacggctggagtggatgcgtattgtcttcagtaggtgggagtgcctactacacgtcccctcccctacagacgtcgacgtaccaacctgtttcggtacgacctacgtccacggtcagtctagttntctctgactacgtcgtaccgtctcgtccaccgggcccgacccggacggacccgggtccgttactaacgtttacgtcgtcggacggtaacggtcgttcgaacgggtccgggttaacccggtaaaacccccttacgttaaacccccgtttaagtttccgaaacccggttacccgggttcgggggaccccgaacgggggtaaccccgggtcggtcccctacccgggtaccttaccccgttccgaacccggtaacccccg

SEQ ID NO: 425431 - DNA, 698 bp, Homo sapiens
  misc_feature: GZ8MTXP01BMF54.25.87.H10.1.454.CMB.2.raw
  modified_base (222)..(222): a, c, t, g, unknown or other
  modified_base (242)..(242): a, c, t, g, unknown or other
  modified_base (249)..(249): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctgtnactccatcacagtaatgctnattacgnggggctggctccgccacgcccccgaggggaacgggccgtggacgtggattggcgtatttgttctttacagttaggtgggagttcgacccttaactacctacgttcccccttacccctacgtaaacggtacggtcccgtagttacccaaccctaagttttccgggttacgaaccaccgtacccgacgcaacggtctagtttcgtcctctacgactacgttggacttcgtcgaccgaccggccgacccgacgaccggtccgttacttagttaccgtggtcgacgtaagggacgttccgaacgggtcccgggttaaaccggaaaaccccctaacccttaaacccccgtttacgttacgggaacccttacccggggttacgggggaccccaacgggggtaaccccgtcggttcccgaaaccccggttcccaacccgttcccgaacgtcccccg

SEQ ID NO: 425432 - DNA, 681 bp, Homo sapiens
  misc_feature: GZ8MTXP01A5NNF.25.87.H10.1.454.CMB.2.raw
  modified_base (222)..(222): a, c, t, g, unknown or other
  modified_base (240)..(240): a, c, t, g, unknown or other
  modified_base (246)..(246): a, c, t, g, unknown or other
  modified_base (255)..(255): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnatacgngggctggcnccgccacgccccgagggacggcctggagtggattgcgtattgtctttcgagtaggtgggagtcgacctactacgtacgttcccctacccctacgaagtgtaccgacgttacccaaccttgtttccgggtcgaccgtaccgtcccaacggcaaggtcctagttcgtccgtactaggacctacgttcggtaaccgttccgtcggtcccgaacccggggcccgacccggtaaccggacccggggtcccgttacttacgttaccgtggttcggacgaacgtcgtaccgacgggtacccgggtaccggtaaaccccctacgttaacccccttacgtttcggaaccccgtaccgggttcgggggacccttacgggggtaaccccgttcgggtccctaacccgggttccacccgttcgaacccggtaaccccg

SEQ ID NO: 425433 - DNA, 673 bp, Homo sapiens
  misc_feature: GZ8MTXP01CYDTT.25.87.H10.1.454.CMB.2.raw
  modified_base (223)..(223): a, c, t, g, unknown or other
  modified_base (242)..(242): a, c, t, g, unknown or other
  modified_base (247)..(247): a, c, t, g, unknown or other
  modified_base (256)..(256): a, c, t, g, unknown or other
  modified_base (275)..(275): a, c, t, g, unknown or other
  modified_base (297)..(297): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnactcatcacagtaatgctnatcgngggctggcnccgcacgcccgaggacgcnggatggatgcgtattgtctttnatggtgggatcgccttacactacgtcccctcctacaagcgtccgagtacctactgtttcggtcaccacgtccacgcagtctagttcgtctcgtacgaaccgtacgttacgacgttccgtacggttcccggaccccgggtacccgaccccggtaaaccggggtccccggggttccgttacttaacgtttaccgtcggtacggacggtaacgtacggtaccggaaccgggtaccgggttaacccggaaaaacccccttccgttaaacccccgtttacgttacgaaaccccggtcggggttaccgggggacccgttaaccgggggtaaacccggttcggtcccctaaccggtccaacccgttccgaaccgtaacccccg

SEQ ID NO: 425434 - DNA, 623 bp, Homo sapiens
  misc_feature: GZ8MTXP01CFBLS.25.87.H10.1.454.CMB.2.raw
  modified_base (221)..(221): a, c, t, g, unknown or other
  modified_base (236)..(236): a, c, t, g, unknown or other
  modified_base (240)..(240): a, c, t, g, unknown or other
  modified_base (255)..(255): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactccatcacagtangctnattactgggctggcncgccacgccccgagggaggcctggagtggattgcgtattgtctttcagtaggtgggagtgcctactacacgtccctccccctacaagcgtcgacgtcactgtttcgttgactacgtccacgcagctagttcgtctctagactacgtcgtacgtctacgtcgaaccgggtccgacccgaacgccgggtacccgttctaacgttacctggtcgtcggaaacgtcgtacgacggtcccgggttaacgaaaacccccctacgttaaacccccgttacgtttacggacccgtaaccggttccgggggcccaaacgggggtaacccttcgggtaaccctaacccggtcccaacccgttccgaacccggtccccc

SEQ ID NO: 425435 - DNA, 780 bp, Homo sapiens
  misc_feature: GZ8MTXP01A4EEC.25.87.H10.1.454.CMB.2.raw
  modified_base (191)..(191): a, c, t, g, unknown or other
  modified_base (222)..(222): a, c, t, g, unknown or other
  modified_base (240)..(240): a, c, t, g, unknown or other
  modified_base (247)..(247): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtnactcatcacagtatgctnattacgngggctggcnccgccacgccccgaggacggcctggagtggatgcgtattgtctttcagtggtgggagtcgaccttaactaccacggttccccctaccccgtacgaaagtacgtaccgacgtaaccctaacccttggttttcccgggttacgaacccgtaacccggtccccaacggcgtaacgtacctacggttttcggtacctcgttacgaaccctaacgttcggtaaccgttccgttaccggtcccgaaccggggtccccgtacccggaaccgggtaacccggggtcccggtttaccttaaaccggtttacgtcgggttcggaaccgggtacgtacgggttccaaacgggggtcccgggttaaaccccgggtaaaaccccccttaaccgttaaacccccccgttttaaacgtttaccggaaaccccggtaacccgggttcgggggaaccccttaacggggggtaaacccccgttcgggtaaccccgtaaccccgggttccaaaccccggttcccgaacccggtaaccccccgg

SEQ ID NO: 425436 - DNA, 660 bp, Homo sapiens
  misc_feature: GZ8MTXP01BEGKX.25.87.H10.1.454.CMB.2.raw
  modified_base (222)..(222): a, c, t, g, unknown or other
  modified_base (309)..(309): a, c, t, g, unknown or other
  modified_base (331)..(331): a, c, t, g, unknown or other
  modified_base (345)..(345): a, c, t, g, unknown or other
  modified_base (348)..(348): a, c, t, g, unknown or other
  modified_base (369)..(369): a, c, t, g, unknown or other
  modified_base (389)..(389): a, c, t, g, unknown or other
  modified_base (393)..(393): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgtgggctcggctccgtcacgcccccgagggacggccgtggacgtggattgcgtattgtctttanagtagtgggagtgcctactacncgtcccctccccanagngtcgatcactgttcggtcacncgtccacgcagtctaggttntctntcgactacgtcgacgtcttcggccgaccggccgtacccggaccgggtacccgggtccggtttaccttacgtttacccgtggttccggacggtacggtacggtaccgtaacggtaccggggttaaccccggtaaaaccccccttaccgttaaacccccgtttacgttttacggaacccgtacccgggttccggggggacccgttaacggggtaacccggttcggtcccgtaacccggtccttaccccgttcccgaacccggtcccccg

SEQ ID NO: 425437 - DNA, 566 bp, Homo sapiens
  misc_feature: GZ8MTXP01D54MY.25.87.H10.1.454.CMB.2.raw
  modified_base (223)..(223): a, c, t, g, unknown or other
  modified_base (242)..(242): a, c, t, g, unknown or other
  modified_base (246)..(246): a, c, t, g, unknown or other
  modified_base (251)..(251): a, c, t, g, unknown or other
  modified_base (254)..(254): a, c, t, g, unknown or other
  modified_base (258)..(258): a, c, t, g, unknown or other
  modified_base (274)..(274): a, c, t, g, unknown or other
  modified_base (359)..(359): a, c, t, g, unknown or other
  modified_base (385)..(385): a, c, t, g, unknown or other
  modified_base (448)..(448): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctnatcngggcngcncgcncgcccgaggagctggngtgatgcgtattgtcttcagtggtgggatcgcctactacacgtcccctccctacagcgtcagtcctactaagtttcggtcgaacncgtaccacgcagctagttgtctcgtnactacgtcgtactcgtgaccgccggccgccgacgccgggtcctacttatccgtgtcgacgagngtcgaggacccggtaccgaaaacccctccttaaccctcgtttagacccgtaccggttcggggacccttacggggtaacccgttcggcctaacccggtcaacccttccgcgtaaccccg

SEQ ID NO: 425438 - DNA, 527 bp, Homo sapiens
  misc_feature: GZ8MTXP01AFCEQ.25.87.H10.1.454.CMB.2.raw
  modified_base (222)..(222): a, c, t, g, unknown or other
  modified_base (240)..(240): a, c, t, g, unknown or other
  modified_base (254)..(254): a, c, t, g, unknown or other
  modified_base (322)..(322): a, c, t, g, unknown or other
  modified_base (336)..(336): a, c, t, g, unknown or other
  modified_base (431)..(431): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnatactgggctggcnccgcacgccccgagggaggcctggagtggattgcgtattgtctttcagtagtgggagtgcctactacncgtccctcccctanaagcgtcgagtacacctgtttcggtcacacgtcacgcagctagttgctctagacactgactctgcacggccgccgacgacggtccgtctattacngtgacgagcgtcaggcggtaccgaaaccctcaaaccctcttcgaccgaccggttcggggcacgggaaccgtgtccaccgtcacctcgaacgtcccc

SEQ ID NO: 425439 - DNA, 661 bp, Homo sapiens
  misc_feature: GZ8MTXP01C2BCI.25.87.H10.1.454.CMB.2.raw
  modified_base (203)..(203): a, c, t, g, unknown or other
  modified_base (222)..(222): a, c, t, g, unknown or other
  modified_base (248)..(248): a, c, t, g, unknown or other
  modified_base (257)..(257): a, c, t, g, unknown or other
  modified_base (386)..(386): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactcatcaccagtatgctcattacgngggctggcnccgccacgccccgagggacggcctggagtggattggcgtattgtctttcagttaggtgggagtcgaccttactacgacgttccccctcccctacaaagacgtcgacgttaccaacctaagtttcgggtnaacaccgtccacgcagctagttctctctgacactcgactctcgccacgggcccgccgaacgccggggtcccgttactaacgtttccgtggtcgacggtaagtcgtaccgacgggtacccgggtaaccggtaaaaccccccttaaccgaaaccccccgtttaacgtttccgggaaaccccgtacccgggttacggggggccccgttaaacgggggtaaccccgttggggtaacccccaacccgggttccaaaccccttcgaaaccccggtcccccg

SEQ ID NO: 425440 - DNA, 601 bp, Homo sapiens
  misc_feature: GZ8MTXP01BDFB1.25.87.H10.1.454.CMB.2.raw
  modified_base (204)..(204): a, c, t, g, unknown or other
  modified_base (223)..(223): a, c, t, g, unknown or other
  modified_base (242)..(242): a, c, t, g, unknown or other
  modified_base (249)..(249): a, c, t, g, unknown or other
  modified_base (258)..(258): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctnacctgctctgtctctggtnactccatcacagtatgctnattacgngggctggcnccgccacgccccgaggacggctggagtgatgcgtattgtctttcatggtgggagtcgacctactacacgttccctcccctacgaagcgtcgaagtcccaacttgtttcgggtcgactaccgtccacggcagtcagtttcgtctctgaacctactgtacgttctcgcgaccgggccgacccgacgacccggcgttactacgttaccgtggtcgccggaagtacgtcgaacgggccggtaacccggtaaacccctaccgaaaccccgtttactttcgaaccgtaccggttcgggggccacgggggtaaccctgggtaaccacccgtcacccgtcgaacgtccccg

SEQ ID NO: 425441 - DNA, 647 bp, Homo sapiens
  misc_feature: GZ8MTXP01AOMMO.25.87.H10.1.454.CMB.2.raw
  modified_base (223)..(223): a, c, t, g, unknown or other
  modified_base (344)..(344): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgaacgaccctgtccctcacctgctccgtctctggtnactccatcacagtatgctcattacgtgggctggctccgccacgccccgagggacggctggagtggattgcgtattgtctttcagtaggtggatcgcctactacacgtcccctcctccaagngtacgacgtccaaacctagtttcggtagacctaccgtccacgcagtctagttcgtctcgtagacctacgtgaccgtcgtgtccgacccggcccgaccgaccaccggggtacccgttcttaacgttaccgtggtcgacggagacgtcacgggtaccggtaacccggaaaccccctaacgtaaacccccttagtttaccggaacccgtacccgggtcgggggaccccgaacgggggttaaccccggttgggtaccccgtaacccggttcccaccccgttaccgaaccgttcccccgtaaccccgg

SEQ ID NO: 425442 - DNA, 657 bp, Homo sapiens
  misc_feature: GZ8MTXP01BIV9T.25.87.H10.1.454.CMB.2.raw
  modified_base (203)..(203): a, c, t, g, unknown or other
  modified_base (222)..(222): a, c, t, g, unknown or other
  modified_base (248)..(248): a, c, t, g, unknown or other
  modified_base (367)..(367): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactccatcacagtaatgctcattcgnggggctggctccgccacgccccgagggaggcctggagtggattgcgtattgtctttcagtaggtgggatcgcctactacacgtcccctccctacaagcgtcgagtccactgtttcggtnacacgtcacgcagctagttcgtctcgtagacctacgttcgacgttcgtcgcccgaccgggtcccgcccgaacggtacccgggtcccgttactaacgtttacgtcggtcggccggtaagacggttccgaggtaccccgggttaaccggtaaaaaccccccttaccgttaaaccccccgttagtttaccggaacccgtaacccggttcgggggacccgttaacgggggtaaaccccgttcggggttaacccaacccccgggttaccaaccccgttccgaaccgggtcccccg

SEQ ID NO: 425443 - DNA, 546 bp, Homo sapiens
  misc_feature: GZ8MTXP01ALU6K.25.87.H10.1.454.CMB.2.raw
  modified_base (222)..(222): a, c, t, g, unknown or other
  modified_base (242)..(242): a, c, t, g, unknown or other
  modified_base (357)..(357): a, c, t, g, unknown or other
  modified_base (383)..(383): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctnattactgggctggctccgccagcccccgagggaacggcctggagtggattgcgattgtctttcagtagtgggagtgcctactacacgtccctcccctcagagtcgagtacacctntttcggtgacacgtcacgcagcagtntctctgacactgacgtctgtcgacggccgccgacgaccggccgtctataccgtgtcgcgtagacgtcaggtccggtacggaaaccccctgaaacccccttgttacgaccgtacccgttgggggcccaggggaaccctggtccaccggtcacctcaacgtcccc

SEQ ID NO: 425444 - DNA, 577 bp, Homo sapiens
  misc_feature: GZ8MTXP01D2V4G.25.87.H10.1.454.CMB.2.raw
  modified_base (203)..(203): a, c, t, g, unknown or other
  modified_base (221)..(221): a, c, t, g, unknown or other
  modified_base (244)..(244): a, c, t, g, unknown or other
  modified_base (253)..(253): a, c, t, g, unknown or other
  modified_base (294)..(294): a, c, t, g, unknown or other
  modified_base (331)..(331): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctgtnactcatcacagtatgctcatcgngggctggcnccgcacgcccgaggacggctggagtgatgcgtattgtcttnagtggtggagtcgaccttacacacgtcccctccctanaagtcgtcgacgttaccaacccttgtttccggtagaccgaccgtccacgcacgctagttcgctctacggactacgtgtacgtccgtagccgaccggccgaccgacgacgtccgtatacttgtgcgcgagtcgtcacggtccggtaaccgaaacccctaacttacccgttacttacgaaccgtccggttacggggacccgacggggtaaccctcggaacctaccggtcaccctcgaacgtaaccccc

SEQ ID NO: 425445 - DNA, 580 bp, Homo sapiens
  misc_feature: GZ8MTXP01APBIT.25.87.H10.1.454.CMB.2.raw
  modified_base (192)..(192): a, c, t, g, unknown or other
  modified_base (224)..(224): a, c, t, g, unknown or other
  modified_base (250)..(250): a, c, t, g, unknown or other
  modified_base (260)..(260): a, c, t, g, unknown or other
  modified_base (305)..(305): a, c, t, g, unknown or other
  modified_base (330)..(330): a, c, t, g, unknown or other
  modified_base (373)..(373): a, c, t, g, unknown or other
  modified_base (401)..(401): a, c, t, g, unknown or other
  modified_base (464)..(464): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcagggtgaagccttcgganaccctgtcccctcacctgctctgtctctggtnactccatcacagtatgctcattacgngggctggccnccgccacgccccgagggacggctggagtggatgcgtattgtcttnagtggtgggactcgaccttactacncgtcccctccctacgaagcgtcgacgtccaccttgttcggtanacctacgtccacgcagtctagttgtctntcgactacgtgtaccgtctcgacgaccggccgtaccgacggccggtcgtacttacgtacgtgngacgtagacgtcgacgtaccggaccgtaacccctacacccgttacttacgacctccgggttcggggaccttacggggtaaccgtcggtcccaccggtccaccgtcgccgtaacccg

SEQ ID NO: 425446 - DNA, 646 bp, Homo sapiens
  misc_feature: GZ8MTXP01D05SX.25.87.H10.1.454.CMB.2.raw
  modified_base (222)..(222): a, c, t, g, unknown or other
  modified_base (236)..(236): a, c, t, g, unknown or other
  modified_base (247)..(247): a, c, t, g, unknown or other
  modified_base (257)..(257): a, c, t, g, unknown or other
  modified_base (298)..(298): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtangctcattacgngggctcggcnccgcacgcccgaggaggctggagtgatgcgtattgtctttnagtggtgggagtcgaccttactacacgtcccctacccctagaagacgtcagtccaactgtttcgtgacctcgtcacgcagctagttctctcgtcactacttcgacgttcgtgaccgaccggccgaccgacggtacccgggtccgttattacgttaccgtggtcgacggtaaacggtcgaccgtacgggtacccggttaaacccggtaaaacccccttaccgttaaacccccgtttagtttaccggaacccgttacccgggttaccgggggccgttaaaacccgggggtaaccgtttccgggaacccttaccccggaccttaacccgttcccgttaaccggtccccccg

SEQ ID NO: 425447 - DNA, 630 bp, Homo sapiens
  misc_feature: GZ8MTXP01EJ39M.25.87.H10.1.454.CMB.2.raw
  modified_base (222)..(222): a, c, t, g, unknown or other
  modified_base (243)..(243): a, c, t, g, unknown or other
  modified_base (250)..(250): a, c, t, g, unknown or other
  modified_base (259)..(259): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctnattacgngggctggcnccgccacgccccgagggacggcctggagtgattgcgtatttgtctttcgagttaggtgggtagtcgtaccttactactacgttccccctccccctacgaaagtacgtaccgaacgtccctaacctaagttttccgggtacgacctaccgtccaacgctagctagttcgtctcttcgactacgtcgacgtctcgtccgacggccgccgacgtaccggtccgttactagttaccgtgtacgccgtagtacgttcgaacggtccggttaacggaaaaccccctacttaaaccccgttactttaccgaccgtaccggttacggggccaacggggtaacccgtggtaaccacccggtcacccgtcgcggtaacccc

SEQ ID NO: 425448 - DNA, 736 bp, Homo sapiens
  misc_feature: GZ8MTXP01BY61J.25.87.H10.1.454.CMB.2.raw
  modified_base (243)..(243): a, c, t, g, unknown or other
  modified_base (300)..(300): a, c, t, g, unknown or other
  modified_base (334)..(334): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctccacctcgctctgtctctggtcgacccactcaccagtaatnctctattacgtgggcgtgctccgccacgccccgcgggaagggccgtcggaggtaggngttgtcgatttgttctttctagtagtgggaggtnccgtacctactacgtcccttccctaccgacgagtcgtacgtcgtaaaccctacgttttcggtttcgaccgtacgtaccccgacgacgacgtaccgagttttgtcctcgttcggaacactttacggcgttactccggtacgaccccgggcccggcccgtaaaccaccccgggggggtccgtttcctttaaacttacggtttcgggtcgacccggggtagtaaaccgggttccgaaccgggggtaccggtttaacccggggaaaaaccccccccttaaccctaaacccccgttttacgtttacggccgtaaaccccggggtcgggggacccgaaccgggggaaaccccgttggggttacccaaccccgttcccaacccgttcgtaaccggccccctaaccccgg

SEQ ID NO: 425449 - DNA, 625 bp, Homo sapiens
  misc_feature: GZ8MTXP01BX7TV.25.87.H10.1.454.CMB.2.raw
  modified_base (239)..(239): a, c, t, g, unknown or other
  modified_base (249)..(249): a, c, t, g, unknown or other
  modified_base (258)..(258): a, c, t, g, unknown or other
  modified_base (261)..(261): a, c, t, g, unknown or other
  modified_base (300)..(300): a, c, t, g, unknown or other
  modified_base (334)..(334): a, c, t, g, unknown or other
  modified_base (472)..(472): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagccttcggagaccctgtccctcacctgctctgtctctggtgactcatcaccagtaangctcatacgngggctggcnccncacgcccgagggaggctggagtgatgcgtattgtctttnagtggtgggatgcctactcacgtccctacccctnagcgtcgacgtacactgtttcgtagacacgtcacgcagctagttcgtctctcgactacgtgtacgtcgtgtacccgaccgggacccgtccccggaacggggtacccgggttcccggtttacttaacgttttacccggnggttacgggacggtaacggtcgtaccggtacgggtaacccgggttaaccccgtaaacccccttaacccttaacccgtttacgttacgaacccgtccgggttacgggaccggacgggtaaccgtcgtcccgcctacccgacctcgcccgtcccg

SEQ ID NO: 425450 - DNA, 635 bp, Homo sapiens
  misc_feature: GZ8MTXP01EIDPT.25.87.H10.1.454.CMB.2.raw
  modified_base (222)..(222): a, c, t, g, unknown or other
  modified_base (249)..(249): a, c, t, g, unknown or other
  modified_base (310)..(310): a, c, t, g, unknown or other
  modified_base (408)..(408): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattacgngggctggctccgccacgcccccgaggggaacggcctggagtggattgcgtatttgtctttnagtaggtgggatcgcctactacacgtcccctcccctacaagtcgtcgacgtaccaaccttgtttcggtagaccacggtccacgcagctagttgtcctntcgactacgtcgtacgtctgtccgaccggccgccgacggaccggtccgttacttagttaccgtggtcgacggagtacgtccgacggtccgggtaaccgggaaaacccccttaccgttaaaccccttacgtttacggaacccgtaccggttacgggggcccgttaacggggtaacccggttcgggtaaccctacccggtaccacccgttaaccgaaccgtaacccccg

SEQ ID NO: 425451 - DNA, 641 bp, Homo sapiens
  misc_feature: GZ8MTXP01A5NN2.25.87.H10.1.454.CMB.2.raw
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactcatcacagtatgctcattacgtgggctggctccgccacgcccccgagggacggcctggagtggattgcgtattgtctttacagttaggtgggtagtcgaccttactacgacgttcccctaccccctacgaagacgtcgacgtaccaacccgttgtttcgggtacgaccgacgtccgaacgcaacgcctagtttcgtcctctacggactaacgttcgtacctcgtcgtaccgaccggcccgacccgacggtacccggtccgttacgttacgttaccgtgtacgcgtaaagcgtaccgacggtaccggtaaccggtaaaacccctaccgttaccccgttacgttcgaaccgtacggttcggggaccgacgggtaacccgtcgggtaacctacccggtcacccgtcgaacggtccccg

SEQ ID NO: 425452 - DNA, 674 bp, Homo sapiens
  misc_feature: GZ8MTXP01A1Z50.25.87.H10.1.454.CMB.2.raw
  modified_base (222)..(222): a, c, t, g, unknown or other
  modified_base (249)..(249): a, c, t, g, unknown or other
  modified_base (258)..(258): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcgcctgctctgtctctggtnactccatcacagtaatgctcattacgngggctggcnccgccacgccccgagggacggcctggagtgatgcgtattgtctttcagtaggtgggagtcgcctactacacgtcccctcccctacgaagtacgtcacgtcctacctaagtttcgggttcgaccaccgtccacgcagctagttcgtactcgtgacctacgtcgtaccgtcgtggtcccgacccgggcccgcccggtaccgccgggttacccgttccttacgtttacgtcggttcggacggtaacggtcgtaccgagggtaccccgggttaaacccgggaaaccccccctttaaccttaaacccccggttaactttccggaacccgtacccgggttaccgggggcccggttaaccgggggaacccggttccgggtaaccaccccgggttccacccgttaaccgaacccgtaacccccg

SEQ ID NO: 425453 - DNA, 595 bp, Homo sapiens
  misc_feature: GZ8MTXP01AR7M5.25.87.H10.1.454.CMB.2.raw
  modified_base (223)..(223): a, c, t, g, unknown or other
  modified_base (248)..(248): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactcatcacagtatgctcattacgngggctgcnccgcacgccccgagggacggctggagtggattgcgtattgtctttcagtaggtgggagtcgcctactacacgtccctccccacaagcgtcgagtccactgtttcgtacgactcgtccacgcacgctagttcgtctcgtcgacacgtgaccgttcgtcgtccgacggccgacccgacggaccggttccgtacttacgttaccgtgtcgacggacgtgtaccgacggtaccggtaacccggaaaccccctacttaaccccgttgttaccgacgtcccggttagggggcccgttaagggggtaaccctcggtcccacccgtccaccgtccgccgtaaccccg

SEQ ID NO: 425454 - DNA, 581 bp, Homo sapiens
  misc_feature: GZ8MTXP01AJYWJ.25.87.H10.1.454.CMB.2.raw
  modified_base (222)..(222): a, c, t, g, unknown or other
  modified_base (249)..(249): a, c, t, g, unknown or other
  modified_base (258)..(258): a, c, t, g, unknown or other
  modified_base (367)..(367): a, c, t, g, unknown or other
  modified_base (511)..(511): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattacgngggctggcnccgccacgccccgagggacggcctggagtggattgcgtattgtctttcagtagtgggagtcgcctactacacgtccctccctacagcgtcgagtacactaagttcggtnacacgtccacgcagctagttgctactgacactgtacgtctgtccgacgggccgtacccgacgaccgggtcccgttacttagttaccgtggtcgacggagtgtccgaggcccggtacggaaaaccccctacgttaaacccccttnttcgaccgtaccggttcgggggcccaacgggggtaaccctggtcccaacccggtcacctccgcgtccccg

SEQ ID NO: 425455 - DNA, 639 bp, Homo sapiens
  misc_feature: GZ8MTXP01BH2VC.25.87.H10.1.454.CMB.2.raw
  modified_base (222)..(222): a, c, t, g, unknown or other
  modified_base (249)..(249): a, c, t, g, unknown or other
  modified_base (458)..(458): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacnggggctggctccgccacgcccccgagggacggcctggagtggatgcgtatttgtctttcagtggtgggagtcgccttacgtacacgtccctcccctacaagacgtcgagtcaccctaagtttcgggtcgacctacgtccacggtcaacggctagttcgtctctcgactaccgtgacgtctgtccgacggccgccgacgacggtcccgtnttacgttacgtgtcgacggtagacgtccgaggtcccgggtaaccgggtaaacccccttaacccgaaaccccctttacgtttcggaacccgtaaccccggttggggggccccgttaaacgggggtaaccccggttcgggtaacccgtcccgggttacccacccgttccgaacggtccccccg

SEQ ID NO: 425456 - DNA, 601 bp, Homo sapiens
  misc_feature: GZ8MTXP01AN1T0.25.87.H10.1.454.CMB.2.raw
  modified_base (203)..(203): a, c, t, g, unknown or other
  modified_base (222)..(222): a, c, t, g, unknown or other
  modified_base (256)..(256): a, c, t, g, unknown or other
  modified_base (351)..(351): a, c, t, g, unknown or other
  modified_base (365)..(365): a, c, t, g, unknown or other
  modified_base (398)..(398): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactccatcacagtatgctcatacgtgggctggcnccgccacgcccccgagggacggcctggagtggattggcgtatttgtctttcgagtaggtgggagtgcctactacacgtcccctcccctacaaagngtcgagtacacctntttcggtgacacgtcacgcagctagttgtctcngacactgacgtctggtccacggcccgaccgacgacggtccgtctacgttacgtcgtgcgagtcgtcaacggccgggtaaccgaaaaccccctacttaaaccccgttcgtttacggaacccgtacccgggttcgggggcccttaacgggggtaacccgtcgggtaaccacccggttaccacccgtaacgaaccggtaacccccg

SEQ ID NO: 425457 - DNA, 687 bp, Homo sapiens
  misc_feature: GZ8MTXP01EKENW.25.87.H10.1.454.CMB.2.raw
  modified_base (223)..(223): a, c, t, g, unknown or other
  modified_base (249)..(249): a, c, t, g, unknown or other
  modified_base (257)..(257): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactcatcacagtatgctcattacggnggctcgcnccgacaccgccggaggacggcgtggagtgtagtgcgttattcgtacttagtagtaggtggacgtcgtacctactacctccgtccctaccacgtagtcgtacgtacgtacctacgttgttcgtacaccgtaccgtccacgctacgtcgttcgttctacctacgtacgtaactacgttcgtacgtcgtccggtaccgacccggtaccgaccgtaccgggtaccggttaccttacgttacgtacggtcggtacgacggtaaacgtcgtaccgggaaccggtaacccggtaaaccccgtaaaaccccttaccgttaaacccgtttacggttaaccggaaccggtaaccgggttaccgggggaaccgttaaccggggtaaccggtaccgtaaccccgtacccgtacccgaccgtccgttaaccccggtaaccccg

SEQ ID NO: 425458 - DNA, 652 bp, Homo sapiens
  misc_feature: GZ8MTXP01CYXBY.25.87.H10.1.454.CMB.2.raw
  modified_base (222)..(222): a, c, t, g, unknown or other
  modified_base (246)..(246): a, c, t, g, unknown or other
  modified_base (255)..(255): a, c, t, g, unknown or other
  modified_base (351)..(351): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattcgngggctggcnccgccacgccccgagggacggcctggagtggattggcgtattgttctttcagtaggtgggagtcgccttactacgacgtcccctacccctacaagngtcgagtccacctgtttcggtgacacgtccacgtcagctagttcgtctcgtagactacttcggacgttctcggccgaccgggcccgacccggtaaccgggaccgggtcccggttacctttaacgttacgtcgggttacgaccgggagtaacggttccgaacgggtaccgggttaaccggaaaaccccccttacgttaaaccccgtttcgtttacgaaacccgtcccgggttacgggggcccgttaacggggtaacccgtcgggtaaccacccggttccaacccgttccgaacggtcccccg

SEQ ID NO: 425459 - DNA, 639 bp, Homo sapiens
  misc_feature: GZ8MTXP01AJH9P.25.87.H10.1.454.CMB.2.raw
  modified_base (222)..(222): a, c, t, g, unknown or other
  modified_base (241)..(241): a, c, t, g, unknown or other
  modified_base (256)..(256): a, c, t, g, unknown or other
  modified_base (328)..(328): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattcgtgggctggcnccgccacgccccgagggacggcgtggagtggatgcgtatttgtctttcagtaggtgggagtcgcctactacncgtcccctcccctacgaagcgtcgagtaccacctgtttcggtagaccaccgtccacgcagctagttcgtctctgaactcgtacgaccgttcgtacgccgaccggcccgacccggtacggaccggtcccgttacttaacgttacgtggtcgacggaaggtcgtacggaacggtacccgggttaacccggaaaaccccctaacgttaacccccgtttacgtttaccggaaccgtacccgggttacgggggacccgttaacggggtaaccggtccgaaccgtacccggtaccaccgtccgaacccgtaaccccg

SEQ ID NO: 425460 - DNA, 709 bp, Homo sapiens
  misc_feature: GZ8MTXP01AWOP9.25.87.H10.1.454.CMB.2.raw
  modified_base (221)..(221): a, c, t, g, unknown or other
  modified_base (239)..(239): a, c, t, g, unknown or other
  modified_base (245)..(245): a, c, t, g, unknown or other
  modified_base (253)..(253): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcacagtatgctnattcgngggctgcnccgccacgccccgagggacggcctggagtggattgcgtattcgtctttcgagtaggtgggagtcgacctactactacgtcccctcccctacaagtacgtcgacgtacctaacccgttaagttttccgggttacgaacccgtacccggttaccccgaaccggacgtacgtacgttaacggtttcggttacctccgttacgaaccgtaaccgtttcggtaccgtttccgttcggtacccgacccggggccccgtaaccccggaccgggtaccgggtccccggtttactaacgtttaccgtggtacggacggtaagcggtaccgtacgggtacccggttaaaccggaaaaccccccttaccgttaaacccccttcggtttacgaacccgtcccggttacgggggcccttacgggggaacccttcgggcctacccggtcacccctcgcccggtaaccccc

SEQ ID NO: 425461 - DNA, 618 bp, Homo sapiens
  misc_feature: GZ8MTXP01AHLOQ.25.87.H10.1.454.CMB.2.raw
  modified_base (191)..(191): a, c, t, g, unknown or other
  modified_base (222)..(222): a, c, t, g, unknown or other
  modified_base (248)..(248): a, c, t, g, unknown or other
  modified_base (352)..(352): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtnactcatcacagtaatgctcattacgnggggctggctccgccacgcccccgagggaacgggcctgggagtggattggcgtagttcgtctttcgagtaggtgggagtcgcctactacagtcccctcccctanagtagtagagtaccaccgtaatttcgggtacactaccgtccacgcagcctaggttgctcgtgacacgtcgacgtctcggtacgacgggcccgccgaacgtcgggcccgttactactttaccggtgtcggacgtacggtcggtaccgacgggtaccggtaacccgtaaacccctaccgttaaccccttacgttaccgaaccgtccgggttcggggacccgaacggggtaacccgtcggtaacctacccgtcaccctcgaaccgaacg

SEQ ID NO: 425462 - DNA, 614 bp, Homo sapiens
  misc_feature: GZ8MTXP01D6JRV.25.87.H10.1.454.CMB.2.raw
  modified_base (223)..(223): a, c, t, g, unknown or other
  modified_base (241)..(241): a, c, t, g, unknown or other
  modified_base (248)..(248): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactcatcacagtatgctnattacgngggctgcnccgcacgccccgaggacggcctggagtggatgcgtatttgtctttacagtaggtgggtagtcgaccttactacacgtcccctcccctacaagtcgtcgagtacccaacttaagtttcggtacgaacctaccgtccacggtcaagtcctaagtttgtctctgactacgtgtacgtctcggcacggccgccgacgtaccggtcgttctacgttacgtgcggcgaacgtcgtccgaacggtccggtaccggaaaacccctcgttaaaccccttacgtttacgacccgtaccggttcggggaccgttaacggggtaacccgtacggtccgtaacccggtcacccttcgaaccgtaacccccg

SEQ ID NO: 425463 - DNA, 681 bp, Homo sapiens
  misc_feature: GZ8MTXP01D8X9G.25.87.H10.1.454.CMB.2.raw
  modified_base (222)..(222): a, c, t, g, unknown or other
  modified_base (247)..(247): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcatacgngggctggcnccgccacgcccccgaagggacggcctggagtggattggcgtatttgttctttacgagttaggtgggagtcgaccttactacgacgtcccctcccctacgaaagcgttcgactccaacctgttttcggtgacctaccgtccacgcagctagttcgtactctgactacgtgtaccgtctagtcccaccgggcccgacccgaaccggaccgggtcccgttacttacgtttaccgtggtacgcggaagtacgtccgaacgggtccgggtaacccggaaaacccccttaccgttaaacccccgttcgtttaccggaaaccccgtacccggggttaccgggggccgaaacccggggggtaaaccccgttcggggttaaccccgtaaccccgggttacccgaccccttaacccgaaacccgggtcccccccg

SEQ ID NO: 425464 - DNA, 599 bp, Homo sapiens
  misc_feature: GZ8MTXP01AY68H.25.87.H10.1.454.CMB.2.raw
  modified_base (221)..(221): a, c, t, g, unknown or other
  modified_base (245)..(245): a, c, t, g, unknown or other
  modified_base (254)..(254): a, c, t, g, unknown or other
  modified_base (336)..(336): a, c, t, g, unknown or other
  modified_base (373)..(373): a, c, t, g, unknown or other
  modified_base (467)..(467): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcacagtatgctcattacngggctggcnccgccacgccccgaggacggctggagtggattgcgtattgtctttcataggtgggatgacctaatacacgtccctcccctanaagcgtcgacgtaccaccgtaagtttccggtagaccnccgtccaacgcagtctagttgtctcgtacactactgtaccgtcgtcgtccgaccgggccgaccccgacggacggtccgttctacgttaccgtgngccggaagtcgtccgaggccggtaaccgaaacccccttacaaacccccgttattcgaaccgtcccgttgggggccccttagggggtaacccttcgggaacccacccggtcacccgttcgaaccgtaaccccg

SEQ ID NO: 425465 - DNA, 645 bp, Homo sapiens
  misc_feature: GZ8MTXP01A6ZTM.25.87.H10.1.454.CMB.2.raw
  modified_base (223)..(223): a, c, t, g, unknown or other
  modified_base (242)..(242): a, c, t, g, unknown or other
  modified_base (249)..(249): a, c, t, g, unknown or other
  modified_base (322)..(322): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctnattacgnggggctggctccgccacgcccccgagggacggccgtggagtggattgcgtatttgtctttacagtaggtgggngtcgacctactactacgtcccctcccctacgaagtcgtcgactaccaccgtgtttcgggtacaccaccgtccacgcagctagttctactctacggactacgtcggtacgttccgtcgtcccgaccgggccgacccggacggtaacccgggtccgttacgttaacgttacgtcggtggaccgaggtacgtacgacggtccgggtaacccgaaaacccccttaccgttaaaccccgttacgtttacgaacccgtacccggttcggggacccgttaacggggtaaccctcgggtccctacccggtccaccctccgccgtaaccccg

SEQ ID NO: 425466 - DNA, 537 bp, Homo sapiens
  misc_feature: GZ8MTXP01B8T7W.25.87.H10.1.454.CMB.2.raw
  modified_base (237)..(237): a, c, t, g, unknown or other
  modified_base (248)..(248): a, c, t, g, unknown or other
  modified_base (256)..(256): a, c, t, g, unknown or other
  modified_base (292)..(292): a, c, t, g, unknown or other
  modified_base (297)..(297): a, c, t, g, unknown or other
  modified_base (329)..(329): a, c, t, g, unknown or other
  modified_base (344)..(344): a, c, t, g, unknown or other
  modified_base (352)..(352): a, c, t, g, unknown or other
  modified_base (375)..(375): a, c, t, g, unknown or other
  modified_base (380)..(380): a, c, t, g, unknown or other
  modified_base (432)..(432): a, c, t, g, unknown or other
  modified_base (440)..(440): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctgtgactccatcacagtangctcattacgngggctgcncgcacgcccgaggaggctggagtgatgcatgtcttnatagnggatcgctactacacgtccctacccgtcaagngtcgagtaccaactnttcggtanacctacgtcacgcaggctagttnctctnacgatggactctgccacggcccgaccgtaagccggggtcctactacgttacnggttacgngagacgtcgacgacggtaaccggtaaaccctaaccttaaccctacgttacgtacgtacgacggcggacgggaacgtcgtcgaccgtcactcgcgccg

SEQ ID NO: 425467 - DNA, 582 bp, Homo sapiens
  misc_feature: GZ8MTXP01CDG2A.25.87.H10.1.454.CMB.2.raw
  modified_base (222)..(222): a, c, t, g, unknown or other
  modified_base (258)..(258): a, c, t, g, unknown or other
  modified_base (349)..(349): a, c, t, g, unknown or other
  modified_base (373)..(373): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattactggggctggcnccgccacgcccccgagggagggcctggagtggattgcgtattgtctttcagtaggtgggagtgccttactacacgtccctcccctacaagngtcgagtaccacctgtttcggttnacacgtccacgcagctagttgtctctgacactgacgttcgtagtcaccggccgcccgacgacggtcccgttctacttacgtgttcgcgagacgtcgagtccgggtacgaaaaccccctcgaaaccccttacgtttcgaaccgtccgttcgggggcccaagggggaacccgtcggttaaccgacccggttcaccctcgaacgtaaccccg

SEQ ID NO: 425468 - DNA, 716 bp, Homo sapiens
  misc_feature: GZ8MTXP01BDMX5.25.87.H10.1.454.CMB.2.raw
  modified_base (191)..(191): a, c, t, g, unknown or other
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtcccctcacctgctctgtctctggtnactcatcactagtaatgctacattacgtgggctcggcctaccgcccgacgacccccgaaggggaacggtccgtggagtggattggcgtagtttcgttcctttgagtaggtcgggtagtcgtaccttaactactaccgttccccctacccctacgtaaacggtcgtaccgtacgttaaccaacccgtttaagtttccggttaacgaccctaccgtaccgaacgcgaacgtctaggtttctcctcgtacgactacgtcgaccgttcgcgaccgaccggacccgtaccgaacggtccggttccgttacttacgtttaccgtggtacgaggaacgtacggttccgaacgggttcccggaaaccggtaaaaccccccttaacggttaaacccccctttagttcccggaaaccgtcccggggttaccgggggccgttaaaccggggtaacccgtcggtaaccgaccccggtacaccccggttcaacccggtaacccccg

SEQ ID NO: 425469 - DNA, 640 bp, Homo sapiens
  misc_feature: GZ8MTXP01CM5HL.25.87.H10.1.454.CMB.2.raw
  modified_base (224)..(224): a, c, t, g, unknown or other
  modified_base (251)..(251): a, c, t, g, unknown or other
  modified_base (260)..(260): a, c, t, g, unknown or other
  modified_base (335)..(335): a, c, t, g, unknown or other
  modified_base (352)..(352): a, c, t, g, unknown or other
  modified_base (420)..(420): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtcccctcacctgctctgtctgtggtnactccatcacagtaatgctcattacgngggctggcnccgccacgccccgagggacggctggagtggattgcgtattgttctttacagtaggtgggaatcgtacctactacncgtccctcccctacagngtcgagtaccactgtttcgtacgacacgtccacgcagctagttcgtctcagactacgttcgacgttcncggtccgaccgggccgcccgaacggtccgggtcccttactaacgtttacgtgtcggacgtagggtacgtccgacggtacccgggtaaccggtaaaacccccttaccaaaccccgtttacgttacggaacccgtaccggggttaccgggggcccgaaacgggggtaacccgtcgggtaaccctaacccggtcccgacccgttccgaacccggtaacccccg

SEQ ID NO: 425470 - DNA, 694 bp, Homo sapiens
  misc_feature: GZ8MTXP01DAIDA.25.87.H10.1.454.CMB.2.raw
  modified_base (222)..(222): a, c, t, g, unknown or other
  modified_base (253)..(253): a, c, t, g, unknown or other
  modified_base (262)..(262): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggatcgagcccagggcaggtgaagccttcggagaccctgtcccctcacctgctctgtctctggtnactccatcaacctagtaatgctacattacgngggctggcnccgcacgccccgaggacggctggagtggatgcgtattgtctttagataggtgggtatgtacctactactacgtccccctccctacaaagtgtacgacgtaccaacccttgtttcggtacgaacctacgtcccaacgcaagtctagttctcacgtgaactacgtggtaccttcgtcggaccaccgggacccgaccccggtaacgtaaccccggggtccccgtttaattaaacgtttaccgttggggtcgacggaaacgggtcgttaaccggacgggtaccccgggtttaaacccggaaaaaaaccccccctttccttaaaacccccggtttatttaccgggaaaccctccggggttaccgggggccttaaacggggggtaacccttaggggttcccaaccccggttacaacccttccgaacggttaacccccc

SEQ ID NO: 425471 - DNA, 610 bp, Homo sapiens
  misc_feature: GZ8MTXP01ER13G.25.87.H10.1.454.CMB.2.raw
  modified_base (221)..(221): a, c, t, g, unknown or other
  modified_base (239)..(239): a, c, t, g, unknown or other
  modified_base (245)..(245): a, c, t, g, unknown or other
  modified_base (253)..(253): a, c, t, g, unknown or other
  modified_base (259)..(259): a, c, t, g, unknown or other
  modified_base (425)..(425): a, c, t, g, unknown or other
  modified_base (511)..(511): a, c, t, g, unknown or other
  modified_base (549)..(549): a, c, t, g, unknown or other
  modified_base (591)..(591): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctgnactcatcacagtatgctnatacgngggctgcnccgccncgccccgagggacggccgtggagtgatgcgtattgttcttcagttaggtgggatcggtaccttaacctacctaccgttccccctacccctacgaaacggtcgtacgtacgtacctaaccgtttgtttccgggtacgaccaccgtccacggcagtctagttcgcttntacgactacggtcacgtcacggtcccgacggtacccgacccgaccggtacggtcctttacgttaacttccgtggcgcggaagttcncgaacgccgggtaaccaaaccccttcttaaacccgttnttaccggacctaggggttccggacgacgggtaacctggcccncgtcacctcgaacgtcccc

SEQ ID NO: 425472 - DNA, 731 bp, Homo sapiens
  misc_feature: GZ8MTXP01D70C0.25.87.H10.1.454.CMB.2.raw
  modified_base (222)..(222): a, c, t, g, unknown or other
  modified_base (247)..(247): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgngggctggcnccgcacgccccgaggacggcctggagtggatgcgtattgtctttgataggtgggagtgccttacgtacacgttcccctaccccctacaaggtacgtccgacgttcccaacccttaagtttccgggtttacggaaccctaccgtaccccgaacgggtctaaggcccgttaagtttccgttcgtaactcggaaaccttacgttcggtaccgttccgttcggtacccggaacccggtccccgccccgggtaaaccgcccggggtacccgtttactttaacgttcgtacggttcggaccgtaaaggtgttacccggaggtacccggggttaaacccgtaaaaccccctaaccccgttaaccccgtttaacgtttacggaaccccggttaccggttcggggggaaccccttaaccgggggtaacccgtttcggggaacccctacccgggtcccttaacccgtccggaacctaaccccccg

SEQ ID NO: 425473 - DNA, 683 bp, Homo sapiens
  misc_feature: GZ8MTXP01DGKX1.25.87.H10.1.454.CMB.2.raw
  modified_base (226)..(226): a, c, t, g, unknown or other
  modified_base (251)..(251): a, c, t, g, unknown or other
  modified_base (261)..(261): a, c, t, g, unknown or other
  modified_base (284)..(284): a, c, t, g, unknown or other
  modified_base (305)..(305): a, c, t, g, unknown or other
  modified_base (329)..(329): a, c, t, g, unknown or other
  modified_base (374)..(374): a, c, t, g, unknown or other
  modified_base (382)..(382): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccaggggcaggtgaagccttcggacgaccctgtcccctcacctgcttctgtctctggtnactcatcacagtatgctacattcgngggctcggcnccgccacgccccgagggaggcgnggagtgatgcgtattgtcttnagtaggtgggatcgacctactacncgtcccctcccacagtcgtcgactaccacttgtttcggtcgaccncgtcacgntacgctttttagcgttctcgtgtactacgtcgtacgttcacggccgaccgggcccgacccgaacggtacccggtaccgttactttaacgttcgtcggtacggccggtaaagtacggttaccgaacgggtacccgggttaaaccccgtaaaaacccccttacccgttaaacccccgtttacgtttaaccggaaaccccgttacccggggttaacggggggcccttaaaccgggggttaacccggttcgggaacccctaacccgtcccgttaaccccgttaaccgttaacccggtaacccccg

SEQ ID NO: 425474 - DNA, 684 bp, Homo sapiens
  misc_feature: GZ8MTXP01AEFI3.25.87.H10.1.454.CMB.2.raw
  modified_base (240)..(240): a, c, t, g, unknown or other
  modified_base (246)..(246): a, c, t, g, unknown or other
  modified_base (256)..(256): a, c, t, g, unknown or other
  modified_base (427)..(427): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtcactcatcacagtatgctnatacgngggctcggcnccgcacgccccgagggacggctggagtgatgcgtattgtcttcgagtaggtgggagtcgtaccttacgtaccacgttcccctacccctagaaacgacgtccgacgtacctaaccttgtttccgggttacgaccgtaccgtcccgacgacgtacgtccgtagtttcgtcctntacggactacggtagccgttcgtacgtacccgaacggccccgaccggaaccgggtccggtccgtttacttaacgtttaccggtcggtacgacggtaacgtcggtaccggtaaccgggtaacccgggtaaccccgtaaaaccccttaccgttaaccccggtttacgttaccggaacccggtccggggttaccggggaccggttaccggggtaaccgtccggtaacccgacccgttccgacccgtccgaacccgccccg

SEQ ID NO: 425475 - DNA, 630 bp, Homo sapiens
  misc_feature: GZ8MTXP01BLDXL.25.87.H10.1.454.CMB.2.raw
  modified_base (222)..(222): a, c, t, g, unknown or other
  modified_base (362)..(362): a, c, t, g, unknown or other
  modified_base (389)..(389): a, c, t, g, unknown or other
  modified_base (455)..(455): a, c, t, g, unknown or other
  modified_base (610)..(610): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattacgtgggctggctccgcacgccccgagggagccgtggagtgatgcgtattgtcttcagtaggtggagtcgcctactactacgtccctcctaccagcgtcgatcaacctgtttcggtnactcgtccacgcagctagttcgcttcngacacgtgacgttctcgaccgaccgggccaccgaaccgccgggggtccgttacttacgtttaccgnggtcgacgtaggacgttcgaccgggtaccggttaacccgaaaacccccttaaccgtaaacccccttagtttacggaaccgtaccccggggttcgggggaaccccgttacgggggttaacccgttcgggaccctaacccggccctacccggttacnccgttaaccccgtaaccccg

SEQ ID NO: 425476 - DNA, 587 bp, Homo sapiens
  misc_feature: GZ8MTXP01AMZ2B.25.87.H10.1.454.CMB.2.raw
  modified_base (191)..(191): a, c, t, g, unknown or other
  modified_base (205)..(205): a, c, t, g, unknown or other
  modified_base (224)..(224): a, c, t, g, unknown or other
  modified_base (243)..(243): a, c, t, g, unknown or other
  modified_base (368)..(368): a, c, t, g, unknown or other
  modified_base (379)..(379): a, c, t, g, unknown or other
  modified_base (410)..(410): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganacccctgtcccctnacctgctctgtctctggtnactccatcacagtatgctnattcgtgggctggctccgcacgccccgagggtacggctggagtggattggcgtattgtctttcgagtaggtgggagtcgacctactactacgtccctcccctagagacgtcgagtacctaccgtntttccgggtanacgacgtccgacgctaagctaggttctctcnggaactcgtgacgtctacggccgaccggcccgtaccggaaccgcggtccttacctagttaccgtgcgcgacgacgtcgacgtaccgtaccgtaaccctaacccgttaaccctacgttacgtaccgtaccggttcgggccggacggtaaccggtcgtcgcgtaccgacctcgcgtccg

SEQ ID NO: 425477 - DNA, 689 bp, Homo sapiens
  misc_feature: GZ8MTXP01CKXAH.25.87.H10.1.454.CMB.2.raw
  modified_base (222)..(222): a, c, t, g, unknown or other
  modified_base (254)..(254): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcatcgtgggctggcnccgccacgccccgagggacggctggagtggatgcgtattcgtctttcagttaggtgggagtcgacccttactaccacgttcccctacccccctacaaaggtacgtccgacgtacctaacccgttaagttttccgggttacgaaaccctaccgtcccaacggcaacgtccgtaagttcgtctcgttagacctacgttcggacgttcgtcggtccaacccggggcccgaccccggaaccggtacccgggtccgtttacctacgtttaccgtgtcggaccggtaagcggtaccgtaacgggtcccgggtaaaccggtaaaaccccccttaaccgaaacccccctttacgttacgaacccggtacccggttcgggggacccaacgggggtaacccgtcgggtccctaacccggtccaacccgttccgaaccgtcccccg

SEQ ID NO: 425478 - DNA, 628 bp, Homo sapiens
  misc_feature: GZ8MTXP01BU356.25.87.H10.1.454.CMB.2.raw
  modified_base (222)..(222): a, c, t, g, unknown or other
  modified_base (237)..(237): a, c, t, g, unknown or other
  modified_base (241)..(241): a, c, t, g, unknown or other
  modified_base (247)..(247): a, c, t, g, unknown or other
  modified_base (256)..(256): a, c, t, g, unknown or other
  modified_base (326)..(326): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtangctnattcgngggctggcnccgccacgccccgagggaggcctggagtggattgcgtattgtctttcagtaggtgggatcgcctactacncgttcccctcccctacgaagtacgtccgtacgtacctaccgttgtttcgggtacgacctacgtcccacgcagtcctagttcgtctcgtagactacgtgtacgtcgtcgccgaccggccgcccgacggtacgggtcccttcttacgttactcggtcgacgtaaggcgtcgaggtaccccggtaaaccggaaaaccccccttacgttaaacccccgtttgttcgaaacccggtcgggttacggggccgaacgggggtaacccgtcggtccccaaccggtccaacccgtccaaccggtaaccccg

SEQ ID NO: 425479 - DNA, 673 bp, Homo sapiens
  misc_feature: GZ8MTXP01BT7AW.25.87.H10.1.454.CMB.2.raw
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcaccttctctgtctctggtnactccatcaccagtaatgctcattacgtggggctggctccgccacgcccccgagggacggcctggagtggattgcgtatttgtctttcagtaggtggagtcgcctactacacgtcccctcctcaagagtcgagtccaacctatttcggtgacacgtccacgtcagctagttgtctctgacacgtcggacgttctgtaccgaccgggtcccgaccgaccgacgggggtccctttacgttaacgtttaccgtggtcggacggtacggtacggttccgaacgggtacccggggttaaacccggtaaaaccccccttaaccgtaaaccccccgtttacgtttaccggaaacccgtacccgggttcgggggaccccgttaacgggggttaaacccgttcggggtaccctaacccgggttacccacccgttaccgaaccggttcccctaaccccgg

SEQ ID NO: 425480 - DNA, 690 bp, Homo sapiens
  misc_feature: GZ8MTXP01DJ4ZO.25.87.H10.1.454.CMB.2.raw
  modified_base (224)..(224): a, c, t, g, unknown or other
  modified_base (242)..(242): a, c, t, g, unknown or other
  modified_base (248)..(248): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtcccctcacctgctctgtctctggtnactcatcacagtatgctnattcgngggctgcnccgccacgccccgaggacggcctggagtggattgcgtattgtctttcagtggtgggatcgtacctactacacgtcccctccccctagaagcgtacgacgtccaaccttgtttcggtacgaactaccggtccacgcagctagttcgtactctagactacgttcgacttcgcgtccgaccggggcccgacccggaacggtacccggggtcccgtttacttaaacgtttccgtggtcggacggtaaacggtcgttaccgaaccgggtacccgggtaaccccggtaaaaaacccccttacccgttaaacccccgtttagtttaccgggaacccgtacccgggtttacggggggacccgaaaccggggggttaaacccgttccggggttaaccccaaccccggttaccaaccccgttccgaacccgggtaacccccccg

SEQ ID NO: 425481 - DNA, 624 bp, Homo sapiens
  misc_feature: GZ8MTXP01AZ5GE.25.87.H10.1.454.CMB.2.raw
  modified_base (223)..(223): a, c, t, g, unknown or other
  modified_base (242)..(242): a, c, t, g, unknown or other
  modified_base (249)..(249): a, c, t, g, unknown or other
  modified_base (258)..(258): a, c, t, g, unknown or other
  modified_base (333)..(333): a, c, t, g, unknown or other
  modified_base (350)..(350): a, c, t, g, unknown or other
  modified_base (389)..(389): a, c, t, g, unknown or other
  modified_base (405)..(405): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctnattacgngggctggcnccgccacgccccgagggacggcctggagtggatggtcgtatttgtctttcagtaggtgggagtcgacctactacncgtcccctcccagaagngtcgagtaccaccttgtttcgtacgacctacgtccacgnacgctagttcgtctcngactacgtgacggttctcggaccgaccgggcccgacccggaacgtccggggtcccctttagttaaacgtttccgtggtcgcggaaagtcgtaccggacggtaccgggtaacccggaaaaccccttcgttaaacccctttcgttacgaccgtccgggttcggggaccgttacggggtaacccttgggccaaccggtcccaccgtcgttaacccgtccccg

SEQ ID NO: 425482 - DNA, 679 bp, Homo sapiens
  misc_feature: GZ8MTXP01EZXSM.25.87.H10.1.454.CMB.2.raw
  modified_base (224)..(224): a, c, t, g, unknown or other
  modified_base (249)..(249): a, c, t, g, unknown or other
  modified_base (258)..(258): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtcccctcacctgctctgtctctggtnactcatcacagtatgctcattacgngggctggcnccgccacgccccgagggacggcctggagtggatgcgtatttcgtctttacgagtaggtgggagttcgcccttaacgtacctacgttccccctacccccgtacgaagtacgtcgaacgttaccaaccgttaagttttccgggtacgtacccaaccggttcccacggacaacggtccttaggtttcgtcttacgtagacctacgtacgtacggttccgcggttacccgaccgggtccccgacccgaccgggtaccgggtcccgtttacgttacgtacgtcggtcggacggaagtacgtaccgtaacgcccgggttaaccggaaaaccccccttcgttaaaccccttgtttaccgaccgtacccgggttcgggggaccaacgggggtaacctcggtaaccacccgtcacctcgaacgtaacccc

SEQ ID NO: 425483 - DNA, 622 bp, Homo sapiens
  misc_feature: GZ8MTXP01BQ3Z4.25.87.H10.1.454.CMB.2.raw
  modified_base (223)..(223): a, c, t, g, unknown or other
  modified_base (249)..(249): a, c, t, g, unknown or other
  modified_base (259)..(259): a, c, t, g, unknown or other
  modified_base (306)..(306): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnacctcatcacagtatgctcattacgngggctggccnccgccacgcccccgagggacggcctggagtggatgcgtattgtcttnagtaggtgggatcgacctactacacgtccctcccctacaagtagtacgcgtaccacctaagtttcggtcgacaccgtccacgctagctagttcgtctctcgactacgtgacgtctcggccgacggccgacccgacggaccggtccgttctacttacgcgttcgacgaggtacgtccgacggtccggtaaacccggtaaaccccctaaccgttaaaccccttaccgtttacggaacccgtacccggttcgggggaccgttaacggggtaaccccgttgggtcccaacccggttccaccgttccgccggtaacccccg

SEQ ID NO: 425484 - DNA, 601 bp, Homo sapiens
  misc_feature: GZ8MTXP01BBRW1.25.87.H10.1.454.CMB.2.raw
  modified_base (191)..(191): a, c, t, g, unknown or other
  modified_base (223)..(223): a, c, t, g, unknown or other
  modified_base (249)..(249): a, c, t, g, unknown or other
  modified_base (258)..(258): a, c, t, g, unknown or other
  modified_base (332)..(332): a, c, t, g, unknown or other
  modified_base (425)..(425): a, c, t, g, unknown or other
  modified_base (453)..(453): a, c, t, g, unknown or other
  modified_base (464)..(464): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtcccctcacctgctctgtctctggtnactccatcacagtatgctcattacgngggctggcnccgcacgccccgagggacggcctggagtcggattgcgtattgtctttcagtaggtgggagtcgtcctaactacncgtccctccctacaagtcgtcgagtaccacctaagtttcggtacgactaccgtccacgctaacgcctaggttcactctagactacgtgacgtntcgcgacggccaccgacgacgggtcctntactttacggngtcgacgacgtcgtacgacggtaccgtaacccgtaaacccctaccgttaaacccttacgttacgaacccgtacggttacgggaccgttaacgggtaaccgtcgtaacccaccgtaccaccgtccgaaccgtaacccg

SEQ ID NO: 425485 - DNA, 640 bp, Homo sapiens
  misc_feature: GZ8MTXP01BKTFT.25.87.H10.1.454.CMB.2.raw
  modified_base (224)..(224): a, c, t, g, unknown or other
  modified_base (302)..(302): a, c, t, g, unknown or other
  modified_base (314)..(314): a, c, t, g, unknown or other
  modified_base (422)..(422): a, c, t, g, unknown or other
  modified_base (499)..(499): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagccttcggacgacccggtcctcacctgctctgtctcgtggtnactccatcaccagtatgctctagttacggtgggctcggcctcccgccgacgccccgagggacggccgtggagtgatgngtattgtcttanagtaggtggatgccttactacacgtcccctacccgtagaacgtacgtacgagtccctaaaccttagtttcggttacaccgtacccggtccacgcaagtccgtagtttncctgtcgaacctcgtcgaccgttctcggaccgaccggcccgacgaaccgcgggtccggttactaacttcggtacggngtacggacgtacggtccgtacggtacccggtaaacccgaaccctaaccgtaacccgttacgtaccgaccgtaccgggtcgggaccggacgggttaccgtccggtaccaacccgtccacccgttccgaaccgcccgtaaccg

SEQ ID NO: 425486 - DNA, 595 bp, Homo sapiens
  misc_feature: GZ8MTXP01BTA87.25.87.H10.1.454.CMB.2.raw
  modified_base (222)..(222): a, c, t, g, unknown or other
  modified_base (241)..(241): a, c, t, g, unknown or other
  modified_base (257)..(257): a, c, t, g, unknown or other
  modified_base (415)..(415): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattacgtgggctggcnccgcacgccccgagggaggcctggagtggattgcgtattgtctttcagtaggtgggatgcctactacacgtcccctcccctacaagacgtcgacgtacaccctgtttcggtacgaccacgtccacggcagtctagttcgtctctgacactgacgtcgngtccgacggccgacccgacggaccgggtctactaattcgngtgcgagtcgtccgaggtccggtacggaaaacccccttacgaaaccccgtttacgtttacgaaccgtaccggttcgggggcccaacgggggtaaccctgggtaacccaacccggtcttaaccccgtcgaaccgtcccccg

SEQ ID NO: 425487 - DNA, 647 bp, Homo sapiens
  misc_feature: GZ8MTXP01AM12A.25.87.H10.1.454.CMB.2.raw
  modified_base (191)..(191): a, c, t, g, unknown or other
  modified_base (222)..(222): a, c, t, g, unknown or other
  modified_base (257)..(257): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtnactccatcacagtatgctcattacgtgggctggcnccgccacgccccgagggacggcgtggagtggattgcgtatttgtctttcagtaggtgggatcgcctactacacgtcccctacccctagaagtacgtcgacgtacctacctaagtttcgggtacgacctaccgtaccacgcacgtcctagtttcgtctcgtcgactacgtcgtaccgtcgtcgaccgaccgggaccgtccgaaccgggtacggtccgtttactaacgtttccggtggtcggacggtaacggtacgtaccggtaaccggtacccggtaaaccccgtaaaccccctaccgttaaaccccgttacgttaccggacccggtaccgggttacgggaccgaccgggtaaccgtcgtaacccgacccgtccgaccgtccgccgtcccg

SEQ ID NO: 425488 - DNA, 722 bp, Homo sapiens
  misc_feature: GZ8MTXP01D0IG5.25.87.H10.1.454.CMB.2.raw
  modified_base (225)..(225): a, c, t, g, unknown or other
  modified_base (243)..(243): a, c, t, g, unknown or other
  modified_base (250)..(250): a, c, t, g, unknown or other
  modified_base (259)..(259): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgacccttgtcccctcacctgctctgtctctggtnactcatcacagtatgctnattacgngggctggcnccgccacgccccgaagggaggcctggagtggattgcgtattgtctttacagtaggtgggagtgccttactacacgtcccctcccctctaagacgtcgacgtacccaccgttaagttttccgggttagaaccctaccgtaccacgctaacggtcctaggttcgtctcgtgactaacgtgtaccgtcttcggccgaaccgggcccgtaccgaccggtaccgggtccgttaccgttaacgttcgtcggttcggtaccggaaacggtcggttaccgaacggggtcccgggggttaaacccgaaaaacccccccgtttaccttaaaccccccggtttacgttttaccggaaaccccggtaacccgggttaccggggggttccccgttaaacggggggtaaccccgttcgggggtaacccctaaacccggggttcccaaaccccggttccggaaccccgttccccccgg

SEQ ID NO: 425489 - DNA, 644 bp, Homo sapiens
  misc_feature: GZ8MTXP01BIWAI.25.87.H10.1.454.CMB.2.raw
  modified_base (244)..(244): a, c, t, g, unknown or other
  modified_base (249)..(249): a, c, t, g, unknown or other
  modified_base (257)..(257): a, c, t, g, unknown or other
  modified_base (280)..(280): a, c, t, g, unknown or other
  modified_base (346)..(346): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaacgccttcggacaccctgtccctcacctgctctgtctcgtggtcactcatcacagtatcgctnatcgngggctgcnccgcacgacccgagggacggtcnggagtggatgcgtattgtcttcagtagtgggatcgacctactacaccgtcccctcccctagaaagngtcgacttaccacctggtttcgtacgaccctcgtacccacggcaggtctagttcgtctctcacgtactcgtacgtcctcggacccgaccgggcccgtaccccgaacggggtacccggtccgtttaccacgttttacgcggttagaccggtaaggtaccgtaccggtaacggtcccgggtaaaccccggaaaaccccttaacccgaacccgttaacgtttacccgacgtacccggttacggggccgaaaccgggtaacctccgggtaaccacccggtcaacctccgaaccgtaaccccg

SEQ ID NO: 425490 - DNA, 713 bp, Homo sapiens
  misc_feature: GZ8MTXP01CP7YZ.25.87.H10.1.454.CMB.2.raw
  modified_base (225)..(225): a, c, t, g, unknown or other
  modified_base (243)..(243): a, c, t, g, unknown or other
  modified_base (251)..(251): a, c, t, g, unknown or other
  modified_base (259)..(259): a, c, t, g, unknown or other
  modified_base (299)..(299): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagccttcggacgaccctgtccctcacctgctctgtctcgtggtnactcatcacagtatgctnattacggngggctgcnccgccaccggcccgagggacggcgtggagtggtatgcgtntttcgttaccgtttacgagttaggtgggggtacgtccgtaccctaacttaccgaccgttcccctaccccgtacgaacgtcgtacgacgtaccttaaccttgtttcgtacgacctaccggtcacgcacgtcgtagttcgtctcgtacgacttacgtcgtacgtcgtacggccgaaccgggcccgtacccgaccgggtacccggttacgtttaccttaacgttacgttcgcgggacggtaaaggtcggttaaccgaccgggttaccggtaaacccccggtaaaaccccttaccgttaaccccgtttacgttaccggaacccgggtcgggttacccgggggaccggttaccggggtaacccggttcggtaaccccgtacccgtcccgttacccgtcccgttaacccgtaacccccgg

SEQ ID NO: 425491 - DNA, 699 bp, Homo sapiens
  misc_feature: GZ8MTXP01AXE2U.25.87.H10.1.454.CMB.2.raw
  modified_base (223)..(223): a, c, t, g, unknown or other
  modified_base (241)..(241): a, c, t, g, unknown or other
  modified_base (248)..(248): a, c, t, g, unknown or other
  modified_base (257)..(257): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactcatcacagtatgctnattacgngggctggcnccgccacgccccgagggacggcctggagtggatgcgtattgtctttcagtaggtgggagtcgccttactacacgttcccctcccctacgaagagtccgacgtaccaacctgtttccggtagaccaccgtccgaacgtcaagtcctagtttcgtctcgttaggacctacgttcgacgttcgtcggtaccgaccgggcccgacccgaaccggtccggggtacccgtttcttaacgttaccgtggtacggaccggtaggacggttccggaacgggtcccggggttaacccgtaaaaacccccccgttacgttaaaccccccgtttacgttttaccggaaaccccgtaacccggggttcccggggggacccgttaaaccgggggtaaccggtttccggggaaccctaaccccgggttccaaccccgttccgaacgggtaacccccc

SEQ ID NO: 425492 - DNA, 596 bp, Homo sapiens
  misc_feature: GZ8MTXP01C246M.25.87.H10.1.454.CMB.2.raw
  modified_base (261)..(261): a, c, t, g, unknown or other
  modified_base (307)..(307): a, c, t, g, unknown or other
  modified_base (413)..(413): a, c, t, g, unknown or other
  modified_base (416)..(416): a, c, t, g, unknown or other
  modified_base (572)..(572): a, c, t, g, unknown or other
  modified_base (585)..(585): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtcccctcacctgctctgtctcgtggtcactccatcacctagtatgctcattcgtgggctgccnccgcacgccccgagggacggctggagtggattgcgtattcgtcttnagtaggtgggtagtcgacctactacacgtcccctacccctacgaagcgtccgacgtaacctaccttcgtttcggtagaccacgtccacgcagtctacgttgtctcnacncgtacgtcgtctcgacgccggaccgtcccgacgtccggccttactagtacgtgacgcgtagacgtcgaacggaccggtaacccgtaaaacccctccgaaacccttacgttcgaaacccgtcggttacggggccacggggtaacccgtggtaacccnccgtcaccgtccnccgtaaccccg

SEQ ID NO: 425493 - DNA, 606 bp, Homo sapiens
  misc_feature: GZ8MTXP01B5U0I.25.87.H10.1.454.CMB.2.raw
  modified_base (222)..(222): a, c, t, g, unknown or other
  modified_base (248)..(248): a, c, t, g, unknown or other
  modified_base (257)..(257): a, c, t, g, unknown or other
  modified_base (354)..(354): a, c, t, g, unknown or other
  modified_base (579)..(579): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctacattacgngggctggcnccgccacgccccgagggacggtctggagtggattgcgtatttgtctttacagttaggtggagtcgtacctactactacgtcccctcccctacgaagngtcacgttccaaccgttgtttcggtacgactacgtccacggcacgctagttctactctacgactacgtcgtaccttcgtcgaccgccgggcccgcccggtaacggacccgggttccttacttacgttaccgtggaccgagtacgtacgtccgacggaccggtaaccggaaaccccctacgttaccccttagttcgaccgtacgttcggggaccacgggtaaccgngtccaccgcacctcgaaccgtaacccg

SEQ ID NO: 425494 - DNA, 645 bp, Homo sapiens
  misc_feature: GZ8MTXP01BSU3X.25.87.H10.1.454.CMB.2.raw
  modified_base (204)..(204): a, c, t, g, unknown or other
  modified_base (223)..(223): a, c, t, g, unknown or other
  modified_base (237)..(237): a, c, t, g, unknown or other
  modified_base (241)..(241): a, c, t, g, unknown or other
  modified_base (248)..(248): a, c, t, g, unknown or other
  modified_base (257)..(257): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctnacctgctctgtctctggtnactcatcacagtangctnattacgngggctggcncgcacgccccgagggacggcctggagtggattgcgtattgtctttacagttaggtgggatcggaccttaactacacgtcccctccccctacgaagagtccgacgtacctaaccttgttttcggtacgacctaccgtccaacgtcacgtctagttcgtctctcggactacgtgtacgttcgcgtccgacggcccgtaccgacggtaccggccgttactaacgttccgtggtcgccggtaagcgttaccggaggtaccgggtaccggtaaaaccccctacgttaaccccttagttcgaacccgtaccgggttacggggcccttaacgggggtaacccgttcggtaacccgtaaccccggtccttaacccgttccggaacctaacccccgg

SEQ ID NO: 425495 - DNA, 738 bp, Homo sapiens
  misc_feature: GZ8MTXP01BRREY.25.87.H10.1.454.CMB.2.raw
  modified_base (223)..(223): a, c, t, g, unknown or other
  modified_base (249)..(249): a, c, t, g, unknown or other
  modified_base (258)..(258): a, c, t, g, unknown or other
  modified_base (299)..(299): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtatgctcattacgngggctggcnccgcacgccccgaggacggctggagtgatgctattgtcttnagtagtgggatcgacctacgtacacgtcccctacccctacaaggtcgtacgacgtacctaaccttaagttttccgggttacgaaccgtaccgttacccgaacgcgacgtaccttaaggtttcgtacctcgttaggaccctaacgttacggtaccgttccgttcgggtacccgaacccggggcccccgaacccggtaacccgggtaacccggggttccccggtttaacttaacgtttaacccgtgggttaaccggcggtaaacgggtacgtacccggtaacggggtaccccgggtaaacccgggtaaaacccccccttaacccggttaaaccccctttacggtttaccgaaacccggttcccgggttacgggggacccgaacgggggtaacccgtcgggttaacccaccccggtacaaccccggtcaacccggtcccccg

SEQ ID NO: 425496 - DNA, 696 bp, Homo sapiens
  misc_feature: GZ8MTXP01EH0EK.25.87.H10.1.454.CMB.2.raw
  modified_base (204)..(204): a, c, t, g, unknown or other
  modified_base (218)..(218): a, c, t, g, unknown or other
  modified_base (223)..(223): a, c, t, g, unknown or other
  modified_base (531)..(531): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctnacctgctctgtctntggtnactcatcacagtatcgctcagttacgtgggctcggcctcccgccgaccgaccccggagggaacggccgtggtagtggtattggcgtagtttcgttctttacgagttggtgggtactcgtacctactaccgaccgtcccctaccctagaaacgtcgtacgtactaaccctaacttgtttcgggtacgacccttaccgaccgacggctacgtacgttggttcctctacttggaacctacgtgtaccgttcgtacgaccggacccggaccgtcccgaacggggtccggttcgtttaccttaagtttccggnggtacgacgtacgtacgtaccggtaccgggtaacccggttaaacccgtaaaaccccttaaccgttaacccgttacgttaccgaaccggtaccgggaccggggttaccgttaccggggtaaccgtccgtaacccctaccgtaccgaccctccgaacccgtaacccg

SEQ ID NO: 425497 - DNA, 634 bp, Homo sapiens
  misc_feature: GZ8MTXP01B9W7U.25.87.H10.1.454.CMB.2.raw
  modified_base (224)..(224): a, c, t, g, unknown or other
  modified_base (341)..(341): a, c, t, g, unknown or other
  modified_base (357)..(357): a, c, t, g, unknown or other
  modified_base (379)..(379): a, c, t, g, unknown or other
  modified_base (389)..(389): a, c, t, g, unknown or other
  modified_base (415)..(415): a, c, t, g, unknown or other
  modified_base (479)..(479): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcaccttgctctgtctctggtnacctccatcaccagtatgctcattacgtgggctggctccgccacgcccccgagggaggccgtggagtggattgcgtattgtctttacgagttaggtgggtagttcgacctactaccncgttcccctcccctanaacgtgtcgagtaccctacgtntttcgggtanaccaccgtcacgcagctagttgtctnagaccacgttgacgttctcgaccgacggaccgtcccggaacgacgggtccgtattacgttacgnggtcgcggtaagtacgtacacgggtacccgttaaccggaaacccccttaacttaaacccccgggttatttacggaaacccgtccggttacgggggcccgaacgggggtaaccgttcgggaacctacccggtccaacccgtcgttaaccggtcccc

SEQ ID NO: 425498 - DNA, 620 bp, Homo sapiens
  misc_feature: GZ8MTXP01DHWJK.25.87.H10.1.454.CMB.2.raw
  modified_base (226)..(226): a, c, t, g, unknown or other
  modified_base (261)..(261): a, c, t, g, unknown or other
  modified_base (303)..(303): a, c, t, g, unknown or other
  modified_base (370)..(370): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagcccttcggagaccccttgtcccctcacctgctctgtctctggtnactcatcacagtatgctcattacgtgggctcggcnccgccagccccgaggaggctggagtgatgctattgtactttnagtaggtgggatgaccttactacacgtccctccctacaagagtccgataccacctaagtttcgggtnaccacgtccgagcaagtctgttgtctctagactacgtcgtacgtctgaccgacgggcgtacccggaactcgggtaccgttacttacggttacctggttccgacgtaaacgggtacgtacggtaccggtacccgggtaaacccgtaaaccccttaacccttaaacccgttacgttacgaccgtaccgggttcggggaccgttaacgggtaacctacggtaacccacccgtccaccgtaaccgccgtaaccg

SEQ ID NO: 425499 - DNA, 762 bp, Homo sapiens
  misc_feature: GZ8MTXP01CXFK8.25.87.H10.1.454.CMB.2.raw
  modified_base (204)..(204): a, c, t, g, unknown or other
  modified_base (225)..(225): a, c, t, g, unknown or other
  modified_base (246)..(246): a, c, t, g, unknown or other
  modified_base (264)..(264): a, c, t, g, unknown or other
  modified_base (295)..(295): a, c, t, g, unknown or other
  modified_base (310)..(310): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggatcgagcccagggcaggtgaagccttcggagacccctgtcccctnacctgcttctgtctcgtggtnacctcatcaccagtaatgctntagttacgtgggctggcnccgccacgccccgagggacggctggagtggntgcgtatttgtcttnagtaggtggtagtcgtccctacgtactctccccgtacccctagaaaggtgtaccgacgtacctaacccgttaagttttccgggtaagaacccgtacgttacccgaacgtccgagttaccgtggtttcggtccgtactcggaaaccctaggtcgtaccgtttctcgggtaccccaaccggggtacccgcccgggaacgttcccggggtacctttaccttaaggtttcccgtaggccggttaaccggaaggttaccgttccgaaaccggggtacccggggttaaaacccccgtaaaaaacccccccgttcccgttaaaacccctttccccggtttacgaaaaccccgggccccggggtttacgggggaaacccgttaccggggttaaaccccggtcgggttaaccccaccccgggtttaccgaccccgtttaaccaaccgggttaacccccccg

SEQ ID NO: 425500 - DNA, 710 bp, Homo sapiens
  misc_feature: GZ8MTXP01C88UN.25.87.H10.1.454.CMB.2.raw
  modified_base (250)..(250): a, c, t, g, unknown or other
  modified_base (259)..(259): a, c, t, g, unknown or other
  modified_base (318)..(318): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgccagatgggtcctgtcccagctgcgtctgcaggagtcgagcccgagggcaggtgaagccttcggacgacccctgtcccctcacctgctctgtctctggtcactcatcaacagtatgctcatacgngggctgccnccgcacgccccgagggacggcctggagtgattggctagttgttcttgagtaggtcgggngtcgtacctaactaccgacgtcccccttaccccctacgaaaggtaccgtacgtactaacccgttaacccttgttttacccgggttagaaacccgtacccggtaccccgaacggtctaaacgggtcctttaaggtttccgttctcgtaacgtaccgtacgtcgttaccgttcgttacggacccgacccgggacccgggaccccgtaacggggtaccccggttcgtttaccttaagttcccgtggttcgaacggtaaacgcgttacgaccggggtaccgaaacccggtaaaaccccctacccgttaaacccgtttacttacggacccgtaaccggttccggggacgttaaaccggggccgtcgtccaacccggtcaacccttcgccgaaccccc

SEQ ID NO: 425501 - DNA, 618 bp, Homo sapiens
  misc_feature: GZ8MTXP01BMMIK.25.87.H10.1.454.CMB.2.raw
  modified_base (191)..(191): a, c, t, g, unknown or other
  modified_base (204)..(204): a, c, t, g, unknown or other
  modified_base (244)..(244): a, c, t, g, unknown or other
  modified_base (250)..(250): a, c, t, g, unknown or other
  modified_base (255)..(255): a, c, t, g, unknown or other
  modified_base (259)..(259): a, c, t, g, unknown or other
  modified_base (324)..(324): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtcccctnacctgcttctgtctcgtggtcactccatcacagtatgctnattcgngggcnggcncgcacgcccgaggacggctggagtggatgcgtattgtctttcagtagtgggatcgaccttacacncgttcccctccctacgagcgtcgacgtcaaccttgtttcggtacgacctaccggtccaacgcgaacgtcttagttcgtctctacgactacgtcgtacgtcctcggaccgccggaccgcccgacgggtacggttccttacttacgttacgtgtcgcgaaagtcggtccgacgggtacccggttaaccggaaacccccttaccgttaaaccccttagttccgaaccgtaccggttacgggggccttaacggggaaccgttcggaacctacccggtcacccgttcgaacccgccccg

SEQ ID NO: 425502 - DNA, 655 bp, Homo sapiens
  misc_feature: GZ8MTXP01A7SW0.25.87.H10.1.454.CMB.2.raw
  modified_base (223)..(223): a, c, t, g, unknown or other
  modified_base (241)..(241): a, c, t, g, unknown or other
  modified_base (248)..(248): a, c, t, g, unknown or other
  modified_base (256)..(256): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactcatcacagtatgctnattacgngggctgcnccgcacgcccgagggacggctggagtggattgcgtattgttctttcgagttaggtgggtacgtcgtacccttaactacgaccgttcccctcccctagaacgtacgtacgtacgtacctaccgttaagtttccggtagacctaccgtaccacgcgacgtctagttcgtctacgtagactacgtgtacgtcgacggtaccgaccggcccgaccgacggtaaccgggttccgttacttaacgttacgtggtcggtaccggaacgtcggttaccgacgggtacccggttaacccgaaaaccccttacgttaaacccttacgttcgaaccgtaccgggttcggggacccgttaacggggtaacctcggtaacccaccggttccacccttcgaaccgtaaccccg

SEQ ID NO: 425503 - DNA, 716 bp, Homo sapiens
  misc_feature: GZ8MTXP01BIROI.25.87.H10.1.454.CMB.2.raw
  modified_base (237)..(237): a, c, t, g, unknown or other
  modified_base (313)..(313): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgacgcccgaggggcagggtgaacgcccgttcgggacgaccccttgtccccctcaccctttctctgtctctggtnacctccatccacagttaatgctctagttacgtgggctggcctccgccacgccccgagggaggcctggagtgattgngtattgttctttacgagttacggtggagtcgacctactacgcgtcccctcctacgaagtcgtcgagtccaaccttagtttcggtagaccaccgtcgaacgtcgaagtcgtagtttcgtcctacgtcggaactacgttcgtaaccgttcgttcggcccgaaccggggccccgacccggtaaccggaccgggggttacccgtttacgttaacgttacccggtggtcgggacgtaacggaccggttccgaaccgggtacccgggtaacccggtaaaaccccctaacccgtaaaccccgtttacgtttaccggaccgtaccccggtcgggggttaccccgttacgggggaacccgttccgggaccctaaccccggtcacccgttaccgtaaccgccccgtaaccccg

SEQ ID NO: 425504 - DNA, 687 bp, Homo sapiens
  misc_feature: GZ8MTXP01AGWWX.25.87.H10.1.454.CMB.2.raw
  modified_base (251)..(251): a, c, t, g, unknown or other
  modified_base (261)..(261): a, c, t, g, unknown or other
  modified_base (316)..(316): a, c, t, g, unknown or other
  modified_base (511)..(511): a, c, t, g, unknown or other
  modified_base (664)..(664): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgacgcccagggcaggtgaagccttcggacgaccctgtccctcacctgctctgtctgtgtgactcatcaccagtaatgctctagttcgngggctggccnccgccacgccccgaggacggcgtggagtgtatgcgtgttgttcttcagtggtggngtcgacctacgtacacgtcccctaccctacgagtacgtcgtacgtaccaaccgttgtttaccgggtacgaaccgtacccgtccgacgtacgacgtaccgtaggtttcgtcctacgtacgacctacgtcgtaccgtgtaccgcgacccggaccggacccgacggaccgggttccttacgttaacgttaccgttggnggtaaccgacggtacggtccgtaacggggtacccggtaaaccccgtaaacccccttaaacgttacccccgtttacgttccggaaacccgtccggggttacggggaccccgaacgggggttaacccgtcggttaacccgaccccggttaacccnccgtaaccgaacccgtaaccccg

SEQ ID NO: 425505 - DNA, 583 bp, Homo sapiens
  misc_feature: GZ8MTXP01A6K99.25.87.H10.1.454.CMB.2.raw
  modified_base (223)..(223): a, c, t, g, unknown or other
  modified_base (243)..(243): a, c, t, g, unknown or other
  modified_base (249)..(249): a, c, t, g, unknown or other
  modified_base (259)..(259): a, c, t, g, unknown or other
  modified_base (265)..(265): a, c, t, g, unknown or other
  modified_base (478)..(478): a, c, t, g, unknown or other
  modified_base (490)..(490): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnactccatcaccagtatgctnatacgngggctggccnccgccncgcccccgtagggacggcctggagtggattgcgtagttgttcttacgagtggtacgggagtcggaccttactacctacgttccccctacccccttacgaaaggtcgttaccgacgttaccgacccttaagtttcgggtacactacgtccacgcagtctgttgtctcgtagactacgtgacgtctcgccaccggccgccgaacgcgggtccttntaacgttcgtgngacgtagagtcacggcggttacgaacccctacttacccgtacttcgacgtaccgttgggccgacggaacgtggtcacgcttacgtcaacgccc

SEQ ID NO: 425506 - DNA, 621 bp, Homo sapiens
  misc_feature: GZ8MTXP01E06Y3.25.87.H10.1.454.CMB.2.raw
  modified_base (223)..(223): a, c, t, g, unknown or other
  modified_base (257)..(257): a, c, t, g, unknown or other
  modified_base (334)..(334): a, c, t, g, unknown or other
  modified_base (353)..(353): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcaccagtatgctcatcgtgggctggcnccgcacgccccgagggacgggcctggagtggattgcgtatttgtctttacagttaggtgggagtcgaccttactacncgtcccctcccctacaagngtcgacgtccacctaagtttcggtgacacgtccacgcagctagttcgtctcgtgacacgtcgtacgtctcgccgacgggcccgccgacgacggtccgttctaacttaccgtggtcgcggagcgtcgacggtccgggtaacggaaaccccccttaacgttaaaccccgtttacgttacgaaccgtacccggttcgggggacccttaacgggggtaaccccgtcggttaacccgaaccccggttccacccgttccaaccggtaacccccg

SEQ ID NO: 425507 - DNA, 592 bp, Homo sapiens
  misc_feature: GZ8MTXP01A6O2R.25.87.H10.1.454.CMB.2.raw
  modified_base (225)..(225): a, c, t, g, unknown or other
  modified_base (247)..(247): a, c, t, g, unknown or other
  modified_base (253)..(253): a, c, t, g, unknown or other
  modified_base (261)..(261): a, c, t, g, unknown or other
  modified_base (306)..(306): a, c, t, g, unknown or other
  modified_base (316)..(316): a, c, t, g, unknown or other
  modified_base (330)..(330): a, c, t, g, unknown or other
  modified_base (462)..(462): a, c, t, g, unknown or other
  modified_base (467)..(467): a, c, t, g, unknown or other
  modified_base (472)..(472): a, c, t, g, unknown or other
  modified_base (565)..(565): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcagggtgaagccttcggagacccctgtcccctcacctgctctgtctgtggtnactccatcaaccagtaatgctnattcgngggctgcnccgcacgccccgagggacggctggagtgattgcgtattgttcttnagtggtgggngtcgaccttacacncgtcccctaccctacaagcgtcgactccaacttgttcggtacacgtccgtaccacgcagtctaagtttcgctactggaactcgtcgtaacgtctacgcgaaccggccaccgacgacgggtccttatacgtangtcgngagtntcgacgtccggtaacgtaaaacccctcgttacccttaacgttcggaaccgtcccgggttgggcccgttaacggggtaaccgtcggtaaccccnccggtacaccgtccgttaaccgtcccg

SEQ ID NO: 425508 - DNA, 585 bp, Homo sapiens
  misc_feature: GZ8MTXP01BNBBW.25.87.H10.1.454.CMB.2.raw
  modified_base (204)..(204): a, c, t, g, unknown or other
  modified_base (223)..(223): a, c, t, g, unknown or other
  modified_base (310)..(310): a, c, t, g, unknown or other
  modified_base (324)..(324): a, c, t, g, unknown or other
  modified_base (344)..(344): a, c, t, g, unknown or other
  modified_base (399)..(399): a, c, t, g, unknown or other
  modified_base (491)..(491): a, c, t, g, unknown or other
  modified_base (563)..(563): a, c, t, g, unknown or other
  modified_base (573)..(573): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctnacctgctctgtctcgtgtnactcatcacagtatgctcattacgtgggctggctccgcacgccccgagggacggctggagtgatgctattgttcttcagtaggtggngtcgtcctactacncgtcccctccccacgtaagngtcgacgtacccaacgttgttacggtacgaccacgtccacgtcagtcctagttcncgtctacgactacgtacggtctctcggaccgaccgggccctaccgggacgtaccggggtccttcttaattccgtggtacgacgagtcgacgnggtcccgggtaaacgaaacccctacttacccgtattcggacctaacgcggggcacggggtaacctcggtccnccggtacccnccgtcgccgccg

SEQ ID NO: 425509 - DNA, 588 bp, Homo sapiens
  misc_feature: GZ8MTXP01BFMT0.25.87.H10.1.454.CMB.2.raw
  modified_base (240)..(240): a, c, t, g, unknown or other
  modified_base (244)..(244): a, c, t, g, unknown or other
  modified_base (249)..(249): a, c, t, g, unknown or other
  modified_base (257)..(257): a, c, t, g, unknown or other
  modified_base (502)..(502): a, c, t, g, unknown or other
  modified_base (567)..(567): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaacgccttcggacgaccctgtccctcacctgctctgtctctggtcactccatcaccagtangctnatcgngggctgcnccgcacgccccgaggacggctggagtgatgcgtattgtcttcgagtaggtgggagtcggtacctactaccgacgttccccctaccccgtacgaagtacgtaccgtacgtaccctaacccgttaagtttcgggtaccgaccgtaccgtacccgacgtaccaagtccttaggttctcctcgtaggacctacgtcgtaacgtccgtcgccgaccggccgaccgacgggtacggtcctactacttcggngcgcgtagcgtcgacggaccgtaaccaaccctacttaccgtcgcgaccgtcggcggcgacggtcncgtccgcgcacctcgccgccg

SEQ ID NO: 425510 - DNA, 722 bp, Homo sapiens
  misc_feature: GZ8MTXP01BWH2I.25.87.H10.1.454.CMB.2.raw
  modified_base (223)..(223): a, c, t, g, unknown or other
  modified_base (263)..(263): a, c, t, g, unknown or other
  modified_base (289)..(289): a, c, t, g, unknown or other
  modified_base (306)..(306): a, c, t, g, unknown or other
  modified_base (313)..(313): a, c, t, g, unknown or other
  modified_base (322)..(322): a, c, t, g, unknown or other
  modified_base (363)..(363): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcaccttctctgtctctggtnactccatcaccagtaatgctcatacgtgggctggctcgcncgccccgaggaggcctggagtgatgngtatgtcttcgataggnggtgtcncctctaccngtaccctcctccaacgagtcgactccaactcgtttcggttnacaccggtcacgcagtcgagttcgtcgtctgtacctagaccgtacgtccgtcgtaccgacccgggtcccggaccgtaacccggaacccgggggtcttaccggttaacgttacccgtttaggaacgttccggaaacggtaaggtaccccgtaggtaaacccgggttacccggggtaaaaccccctaacccggttaaaccccccgttaaaccccgttttacggaaacccggtaaaccccggttttaacggggggccccccggtttaaagggggaaacccccccgggttaagggggtcccccgttaaaaccccggtcccggtaacccctttacccgtaacccggggaacccccgtttccccg

SEQ ID NO: 425511 - DNA, 710 bp, Homo sapiens
  misc_feature: GZ8MTXP01D36UY.25.87.H10.1.454.CMB.2.raw
  modified_base (520)..(520): a, c, t, g, unknown or other
  modified_base (532)..(532): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtaatgctcatactgggctggctccgccagccccgagggaacggcctggagtggattgcgtattgtctttacagttaggtgggtaagttcggacccttaacgtacctaacgtccccctacccgtacaaacggacggttccgacggttacccaaaacccgttagttttccgggttagaacccgtaacccgttcccgacggtacaacggtctaacggtttgtccttcgtcgaactaccgttgacgttctcggtcaccgggcccgaccgtacgaccgggggtccccgttnttaatttaccgnggtacgtcggaacgtacggttccgagggtcccgggttacgaaaaaccccccttaacgtaaaaccccccgtttgtttacccgaaacgtccccgggttaggggggaccccttaagggggttaaaccccgtcgggttccaacccgggttccaaccccgttcaaccggccccttaaccccgg

SEQ ID NO: 425512 - DNA, 719 bp, Homo sapiens
  misc_feature: GZ8MTXP01DR0CG.25.87.H10.1.454.CMB.2.raw
  modified_base (221)..(221): a, c, t, g, unknown or other
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagtcctcggagaccctgtccctcacctgctctgtctgtgtnactcatcaccataatcgtctctagttacgngggtctcggccgtcccgcccgaccggaccccccggaaggggacggtcccgtaggagttggtaactttggacgtagtttcgtttctttacgtagttaggtgggtagtccgtaccttaactaccgtacgttccccctacccgcgtaaacgcgtcgtaaccgtccaacttcgtttacggtacgtacccacgtaccacgactacgacgtagtcgtctactacgacgtacctcgtactcgtcgtcccgaccggacccgaccggaccggaacgttccgtaccgttacttacgtacggtgacggtacgtacggtccgtaacgtacccggtaacccgtaaaccccgttaaacccgttaaaccccgttaaccgtttaccggaacccgttaacgggttccggggaacccgttaccggggaacccgttcggtaaccgtacccgtacccgttacccctaacggttaaccctaacccccgg

SEQ ID NO: 425513 - DNA, 660 bp, Homo sapiens
  misc_feature: GZ8MTXP01AJMYU.25.87.H10.1.454.CMB.2.raw
  modified_base (224)..(224): a, c, t, g, unknown or other
  modified_base (245)..(245): a, c, t, g, unknown or other
  modified_base (264)..(264): a, c, t, g, unknown or other
  modified_base (303)..(303): a, c, t, g, unknown or other
  modified_base (451)..(451): a, c, t, g, unknown or other
  modified_base (648)..(648): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagccttcggagaccctgtcccctcacctgctctgtctctggtnactccatcaacagtaatgctntaagtcgtggggctggccnccgaccacgcccccgtaagggacggccgtaggacgtggnttaggcgtaatttcgttcgttttacgaggttaggtgggaacgttcgtaccctaacttaaccgcgttcccctacccctactaagacgtcgagttacaaccttgtttcggtacgtaccaccgtccacgcagtctacgttgtcttcgcganactcgtactcgtcgccaccggccgtacccgaccggtaccggtccgttacctaacgtttcgtacgtggaggtaacgtacggtgaacggtcgggaaccctaaaacccccgtaacttaaacccccgtacggtttcaaccggtaaccggttccggggaaccttacgggggaacccgtacgtccgtacccgtcgaccccgtnaacccgtaaccg

SEQ ID NO: 425514 - DNA, 522 bp, Homo sapiens
  misc_feature: GZ8MTXP02IVZH4.25.87.H10.1.454.CMB.2.raw
  modified_base (222)..(222): a, c, t, g, unknown or other
  modified_base (344)..(344): a, c, t, g, unknown or other
  modified_base (354)..(354): a, c, t, g, unknown or other
  modified_base (362)..(362): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccagcccccagggaacgggcctggagtggattgcgattgtctttcatagtgggagtggctactacagtccctcccctcaagntcgagtcacntttcggtnacacgtccacgcagcagttgtctctgacactgactctgtcacggccgccgacacggccgtctattacctgtgcgagagtcagcggtacggaaaacccctcaaacccctatttcgactaccgtcggggccagggaaccgtggtcaccgtcacctcacgccc

SEQ ID NO: 425515 - DNA, 533 bp, Homo sapiens
  misc_feature: GZ8MTXP02JVFMQ.25.87.H10.1.454.CMB.2.raw
  modified_base (221)..(221): a, c, t, g, unknown or other
  modified_base (298)..(298): a, c, t, g, unknown or other
  modified_base (343)..(343): a, c, t, g, unknown or other
  modified_base (351)..(351): a, c, t, g, unknown or other
  modified_base (388)..(388): a, c, t, g, unknown or other
  modified_base (392)..(392): a, c, t, g, unknown or other
  modified_base (403)..(403): a, c, t, g, unknown or other
  modified_base (416)..(416): a, c, t, g, unknown or other
  modified_base (419)..(419): a, c, t, g, unknown or other
  modified_base (428)..(428): a, c, t, g, unknown or other
tcagactgtacagtcacgaccggtgctcgatttagcagtactgcgttgggtttggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattactggggctggctcgcagcccccaggaggcctggagtggattgcgattgtctttnatagtgggatgctactacagtcctcccctcagagtcgagtcaccntttcggtnacacgtccacgcagcagttgtctctgacactgcgtcngtcncgccgccgacncggcgtctattcngtncgagacgtnaacgcggtacggaaaacccctacaacccctactttacgaccaccgtcgggggacccagggggaacccgtcgggttaccaacccggtccgaacccctacgacgccg

SEQ ID NO: 425516 - DNA, 553 bp, Homo sapiens
  misc_feature: GZ8MTXP02H59NZ.25.87.H10.1.454.CMB.2.raw
  modified_base (370)..(370): a, c, t, g, unknown or other
  modified_base (441)..(441): a, c, t, g, unknown or other
  modified_base (450)..(450): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccagggacggcctggagtggattgcgtattgtctttcagtagtgggagtgcctactacacgtccctcccctcaagcgtcgagtcacctattttcggttanaccacgtccacgcagcagttgtctctgactagtcgacgtctgtcacggccgccgacacggtctctattacngtgcgtagngtcgagcggtacgaaaccccctactaaaccccttcttacgacctaccgtacggggcccaaggggtaacccgtcggtaccaccgtacacccgtcgaacgccccg

SEQ ID NO: 425517 - DNA, 533 bp, Homo sapiens
  misc_feature: GZ8MTXP02GTXYM.25.87.H10.1.454.CMB.2.raw
  modified_base (222)..(222): a, c, t, g, unknown or other
  modified_base (366)..(366): a, c, t, g, unknown or other
  modified_base (414)..(414): a, c, t, g, unknown or other
  modified_base (434)..(434): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggcctccgccagcccccagggaacggcctggagtggattgcgtattgtctttcatagtgggagtgcctactacacgtccctcccctcaagagtcgagtcactgtttcgtnacacgtccacgcagcagttgtctctgacactgacgtctgtcacggccnccgacacggcgtctattacngtgcgagcgtcagcggtacggaaaacccctacaacccctactttcgacctaccgtcggggccaggggaacccgtggtaccaccgtccacctcacgcccc

SEQ ID NO: 425518 - DNA, 639 bp, Homo sapiens
  misc_feature: GZ8MTXP02F2HDO.25.87.H10.1.454.CMB.2.raw
  modified_base (242)..(242): a, c, t, g, unknown or other
  modified_base (366)..(366): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtaatgctnattacgtggggctggctccgccacgcccccgagggacggcctggagtggattggcgtattgtctttcattaggtgggagtcgacctactacacgtcccctcccctacaagagtcgagtccactntttcggtgacaccgtccacgcagctagttcgtctcgtgactacgtgaccgttcgtcgtaccgaccgggccccggacccgaaccgacccggggtccctttacgttaacgtttacgtcggttcggaccgaaggtaacgtccgaacgggtccgggtaacccggaaaacccccttaccgtaaaccccccttagtttaccggaacctacccggtcgggggacccaacgggggtaacccgtcgggtacccacccggtccaacccgtccgaaccgtcccc

SEQ ID NO: 425519 - DNA, 534 bp, Homo sapiens
  misc_feature: GZ8MTXP02J3IO1.25.87.H10.1.454.CMB.2.raw
  modified_base (223)..(223): a, c, t, g, unknown or other
  modified_base (353)..(353): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcaccagtaatgctcattactggggctggctccgccagcccccaggaggcctggagtggattgcgattgtctttcatagtgggagtgcctactacagtccctccccctcagagtcgagtcaccnttcggtgacacgtccacgcagcagttgctctgacactgacgtctgtcacggccgccgacacggccgtctattactgtgcgagagtcagcggtcggaaaaccccctacaaaccccctctttcgaccacccgtcggggacccaaggggaacccgtggtaccacccggtcaccttccgagcccc

SEQ ID NO: 425520 - DNA, 565 bp, Homo sapiens
  misc_feature: GZ8MTXP02IZ5EK.25.87.H10.1.454.CMB.2.raw
  modified_base (347)..(347): a, c, t, g, unknown or other
  modified_base (361)..(361): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccagggaacggcctggagtggattgcgtattgtctttcatagtgggagtgcctactacacgtcccctcccctacaagngtcgagtccacctntttcggtgacacgtccacgcagctagttctctctgacactgacgtctgtcacggccgccgacacgggccgtctattacgtgtacgcgagagtcgaaggtcgggttacggaaaacccccttacgaaacccccttacgtttacgaccgaccgtcgggggacccaggggaaacccgtcgtaccgacccgtcaccgtcaacgtccccg

SEQ ID NO: 425521 - DNA, 538 bp, Homo sapiens
  misc_feature: GZ8MTXP02JT84I.25.87.H10.1.454.CMB.2.raw
  modified_base (340)..(340): a, c, t, g, unknown or other
  modified_base (352)..(352): a, c, t, g, unknown or other
  modified_base (441)..(441): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggctggctccgccagcccccagggaagggcctggagtggattgcgattgtctttcatagtgggagtgcctactcagtccctcccctcaagngtcgagtcaccnttttcggttgccacgtccagcagcagttgtctctgacaccttgacgtctgtaccgacgggcccgcccgtacacggccgttctatttacngtgcgagagtcaaggcgttacggaaaaccccctacaaaccccctactttcggacaccgtcggggccagggaaccgtggtacacgtcacctcacgccc

SEQ ID NO: 425522 - DNA, 542 bp, Homo sapiens
  misc_feature: GZ8MTXP02G4EC4.25.87.H10.1.454.CMB.2.raw
  modified_base (222)..(222): a, c, t, g, unknown or other
  modified_base (370)..(370): a, c, t, g, unknown or other
  modified_base (396)..(396): a, c, t, g, unknown or other
  modified_base (412)..(412): a, c, t, g, unknown or other
  modified_base (423)..(423): a, c, t, g, unknown or other
  modified_base (430)..(430): a, c, t, g, unknown or other
  modified_base (446)..(446): a, c, t, g, unknown or other
  modified_base (496)..(496): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccacgcccccgagggaacggcctggagtggattgcgtattgtcttcatagtgggagtggctactacacgtccctcccctcaagagtcgagtccacctagtttcggttnacctacgtccacgcagcagttcgtcnctgactactgacttcngtcaccggccnccgaacnccgggtcctctatacngtgacgtagagtcagcggtacgaaacccctacaaccccttacttcgaccnccgtacggggaccagggaaccgtcgtaccaccgtcacctcacgccc

SEQ ID NO: 425523 - DNA, 619 bp, Homo sapiens
  misc_feature: GZ8MTXP02HPVZQ.25.87.H10.1.454.CMB.2.raw
  modified_base (250)..(250): a, c, t, g, unknown or other
  modified_base (331)..(331): a, c, t, g, unknown or other
  modified_base (350)..(350): a, c, t, g, unknown or other
  modified_base (370)..(370): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgnggggctggctccgccacgcccccgagggacggcctggagtggattgcgtattgtctttcagtagtgggagtgcctactacncgtccctcccctacaaagngtcgagtcacctgtttcgtnacactccacgcagctagtgtctctgactactgacgttctcgtccgacggccccgaccgacgacccggggtccttacgttaagttaccgtgttgaccggagtacggtcacgggtaccgggtaacccggtaaaaccccctaccgtaaaccccccgttatttccggaaacccgtacccgtcgggggaccctaaagggggtaaccccgtgggtaccctacccgggtacctacccgttaccgaacgtccccccg

SEQ ID NO: 425524 - DNA, 535 bp, Homo sapiens
  misc_feature: GZ8MTXP02GSTAY.25.87.H10.1.454.CMB.2.raw
  modified_base (355)..(355): a, c, t, g, unknown or other
  modified_base (365)..(365): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccaggaaggcctggagtggattgcgattgtctttcatagtgggagtgcctactacacgtccctccccctcaagagtcgagtcaccntttcgtgacncgtccacgcagcagttgctctgacactgacgttctgtcacggccgccgacaccggccgtctattactcgtgcgagagtccagcggtacgaaaacccctacaaaccctactttacgaccaccgtcggggcccaggggaaccgtcggtaccaccggtccacctcaacgcccc

SEQ ID NO: 425525 - DNA, 566 bp, Homo sapiens
  misc_feature: GZ8MTXP02FOS7I.25.87.H10.1.454.CMB.2.raw
  modified_base (307)..(307): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtatgctcattacgtggggctggctccgccacgcccccgagggacggcctggagtggattgcgtattgtctttnataggtgggagtgcctactacacgtccctcccctacaagagtcgagtcacctgtttcgggtgaccacgtccacgccagcagttgtctctgacactcgacgtctcgtccacgggcccgccgacaccgggcctctattactgtgacgagtacgtcgacggcgggtacggaaaaccccctacaaaccccttacttcgacctacccgtcgggggacccaagggggaacccgtggacccacccggtcaccctacgaccgtcccc

SEQ ID NO: 425526 - DNA, 573 bp, Homo sapiens
  misc_feature: GZ8MTXP02HZ8VA.25.87.H10.1.454.CMB.2.raw
  modified_base (220)..(220): a, c, t, g, unknown or other
  modified_base (252)..(252): a, c, t, g, unknown or other
  modified_base (255)..(255): a, c, t, g, unknown or other
  modified_base (277)..(277): a, c, t, g, unknown or other
  modified_base (283)..(283): a, c, t, g, unknown or other
  modified_base (287)..(287): a, c, t, g, unknown or other
  modified_base (294)..(294): a, c, t, g, unknown or other
  modified_base (296)..(296): a, c, t, g, unknown or other
  modified_base (306)..(306): a, c, t, g, unknown or other
tcagactgtacagtcacgaccggtgctcgatttagcagtactgcgttgggttggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatccacagtaatgctcatacgtggcgngcnccgccacgcccgacggaggcgngagtgngtgngtatgtntntagtagtggngtgctactacactcctcccctacagagtacgacgtacactcttacgtacgtacacgtaccacgacacgactagtgtctctacgtactacgtacgtacgtacgtcgtcgaccgccgaccgacgacgtaccgtactacttacgtgtagacgagacgtacgacgaccggtaaccggtaacccgtaaaccctaaccctaaccgttacgtaccgaccgtacggaccggacggtaaccggtacgtaccgtaccgaccgacctaccaccgaccg

SEQ ID NO: 425527 - DNA, 589 bp, Homo sapiens
  misc_feature: GZ8MTXP02IT7CR.25.87.H10.1.454.CMB.2.raw
  modified_base (361)..(361): a, c, t, g, unknown or other
  modified_base (446)..(446): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccgagggacggcctggagtggattgcgattgtctttcataggtgggagtgcctactacacgtccctcccctcaagagtcgagtccacctntttcggttgacacgtccacgcagctagttgctactgacacgtgacgtctgtccgacggcccgccgcgaccggtccgtctattcgngtgcgagacgtcaggtcggaccggaaaacccctaccgtaaaccccttacgtttacggaacctaccccggttacgggggaccctaaacgggggtaacccgtcggtaccgtaaaccccggttcaccccgttacaaccgtcccccg

SEQ ID NO: 425528 - DNA, 531 bp, Homo sapiens
  misc_feature: GZ8MTXP02FSSFV.25.87.H10.1.454.CMB.2.raw
  modified_base (435)..(435): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccagggaacggcctggagtggattgcgattgtctttcatagtgggagtgcctactacagtccctcccctcaagagtcgagtcacctatttcggtgacacgtccacgcagcagttgtctctgacactgacgtctgtccacggccgccgacaccggccgtctattacngtgcgagagtcagcggtacgaaaacccctcaaacccctattgaccaccgtcggggaccacggggaaccgtcggtaccaccggtcacctcacgcccc

SEQ ID NO: 425529 - DNA, 555 bp, Homo sapiens
  misc_feature: GZ8MTXP02IT7C3.25.87.H10.1.454.CMB.2.raw
  modified_base (222)..(222): a, c, t, g, unknown or other
  modified_base (438)..(438): a, c, t, g, unknown or other
  modified_base (484)..(484): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccagcccccagggaacggcctggagtggattgcgattgtctttcataggtgggagtgcctactacagtccctcccctcaagagtcgagtccacctgtttcggtgacctacgtccacgcagcagttgctctgacactgacgtctgtcaccggccgccgacacggtccgtctattccngtgcgagagtccaggacggtacgaaaaccccctacaaacccccttnttacgaacctccgtacggggcccaaggggtaacccgttgggaccctaccggtacacccgtcgaacgtcccc

SEQ ID NO: 425530 - DNA, 529 bp, Homo sapiens
  misc_feature: GZ8MTXP02JZ865.25.87.H10.1.454.CMB.2.raw
  modified_base (427)..(427): a, c, t, g, unknown or other
  modified_base (442)..(442): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccaggaggcctggagtggattgcgattgtctttcatagtgggagtgcctactacagtccctcccctcaagagtcgagtccacctatttcggttgaccacgtccacgcagccagttgtctctgacactgacgtctgtcacggccgccgacacggccgtntattactgtgcgagngtcagcggtacgaaaccccctacaacccctacttcgaccaccgtcggggccaggggaaccgtggtccaccggtcacctcacgtcccc

SEQ ID NO: 425531 - DNA, 553 bp, Homo sapiens
  misc_feature: GZ8MTXP02G35AF.25.87.H10.1.454.CMB.2.raw
  modified_base (372)..(372): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccgagggaacggccgtggagtggattggcgtattgtctttcagtggtgggatgcctactacacgtccctcccctcaagtagtcgagtcacctgtttcggtnaccaccgtccacgcagcagttcgtctctgactactgacgtctgccgacggccgccgacacggtccgtctattacgtgtcgacgagtagtcaggccggtacggaaacccctacaacccttcttacgaccgtccgtcgggacccagggaacccgtcgaccgacccgtcgacctcgacgtcccc

SEQ ID NO: 425532 - DNA, 559 bp, Homo sapiens
  misc_feature: GZ8MTXP02HNJ8J.25.87.H10.1.454.CMB.2.raw
  modified_base (371)..(371): a, c, t, g, unknown or other
  modified_base (424)..(424): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtgactcatcaccagtaatgctcattactggggctggcctccgccacgcccccgagggacggcctggagtggattgcgattgtctttcagtaggtgggtagtgtcctactacacgtccctcccctacaagacgtcgatccactgtttcggttnacacgtccacgcagctagttcgtctctgacactgacgtctgtccaccgggccnccgacaccgggtccgttctacttactgtgcgtagagtcgagtcggtaacgaaaccccctacaaccccttagttacgacctacgtcgggaccacggggaacccgtcggtaccaccggtccaccgtcaccgtacccc

SEQ ID NO: 425533 - DNA, 567 bp, Homo sapiens
  misc_feature: GZ8MTXP02HUTCO.25.87.H10.1.454.CMB.2.raw
  modified_base (221)..(221): a, c, t, g, unknown or other
  modified_base (247)..(247): a, c, t, g, unknown or other
  modified_base (343)..(343): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagctttcggagaccctgtccctcacctgctctgtctctgtnactccatcaccagtatgctcattacnggggctggctccgccacgcccccgagggaggcctggagtggattgcgattgtcttcagtagtgggagtgcctactacacgtcccctcccctcaagngtacgagtccaactgtttcgtgaccaccgtccacgcagctagttcgtctctgacctactcggacgtctcgtcgaccggccgccgtacgaccggtccgttctacttacgtgacgcgagtagtcaaggccgggtacgaaaaccccctacgtaaccccttacttcgaaccaccgtcggggacccaggggaacccgttggacctacccggtacacccgtcaccgtccc

SEQ ID NO: 425534 - DNA, 572 bp, Homo sapiens
  misc_feature: GZ8MTXP02HVU4D.25.87.H10.1.454.CMB.2.raw
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcatacngggctggctccgccacgcccccaggaggcctggagtggattgcgattgtctttcatagtgggagtgcctactacagtccctcccctcaacgagtcgagtccacctagtttcggttagaccaccgttccacgcagccagttgtctctgactactgacgtctgtcaccggccgcccgacaccgggtccttctaacttcctgtcgcgagagttccaggtcggtacggaaaaccccctacgaaccccctatttcgaacctacccgtcgggggacccacgggggtaaacccgtgggtacccacccggttcaaccccttcacggtccccc

SEQ ID NO: 425535 - DNA, 527 bp, Homo sapiens
  misc_feature: GZ8MTXP02F8MM7.25.87.H10.1.454.CMB.2.raw
  modified_base (352)..(352): a, c, t, g, unknown or other
  modified_base (359)..(359): a, c, t, g, unknown or other
  modified_base (426)..(426): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccaggaggcctggagtggattgcgattgtctttcatagtgggatgcctactacacgtccctcccctcaagagtcgagtcactntttcgtnacacgtccacgcagcagttgctctgacactgactctgtcacggccgccgacacggccgtctattacngtgcgagagtcagcggtacgaaacccctacgaaccccttactttacgacctaccgtcggggccaacggggaaccgtcggtaccaccgtcacctcacgtccc

SEQ ID NO: 425536 - DNA, 573 bp, Homo sapiens
  misc_feature: GZ8MTXP02GYK6Q.25.87.H10.1.454.CMB.2.raw
  modified_base (222)..(222): a, c, t, g, unknown or other
  modified_base (310)..(310): a, c, t, g, unknown or other
  modified_base (345)..(345): a, c, t, g, unknown or other
  modified_base (371)..(371): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgtggggctggctccgccacgcccccgagggacggccgtggagtggattggcgtattgtctttnagtaggtgggatgtctactacacgtccctcccctnaagagtcgagtcactgtttcggttanacgacgtccacgcagctagttgtctctgactactgacgtctgtccacgggcccgcccgacgaccgggtcctacttagttactgtgcggagacggtcacggtccggttaacgaaaacccccttacaaccccgttacttcgaccgtaccgtcggggacccaagggggtaaccctggtacccaccgtacaccctcgaccgtcccc

SEQ ID NO: 425537 - DNA, 600 bp, Homo sapiens
  misc_feature: GZ8MTXP02GB6QL.25.87.H10.1.454.CMB.2.raw
  modified_base (222)..(222): a, c, t, g, unknown or other
  modified_base (367)..(367): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgcccccagggaaggcctggagtggattgcgattgtctttcataggtgggatgcctactacacgtcccctcccctcaagagtcgagtccactgtttcggtnacacgtccacgcagcagttgtctctgacactgactctgtcacggcccgaccgacaccggccgttctaattaccgtgtggccgaggtaacgtccgaaggtccgggtaaccggaaaacccccctacgaaaccccctttacgtttacgaaccctacccggtacgggggaccctaaacgggggaaacccgttcgggtacccgaacccggttccaacccgtccgaacggtaccccccg

SEQ ID NO: 425538 - DNA, 543 bp, Homo sapiens
  misc_feature: GZ8MTXP02HOO8Y.25.87.H10.1.454.CMB.2.raw
  modified_base (352)..(352): a, c, t, g, unknown or other
  modified_base (360)..(360): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccagggaggcctggagtggattgcgattgtctttcatagtgggagtgcctactacagtccctcccctcaagcgtcgagtcacntttcggtnacacgtccacgcagcagttgtctctgacactgacgtctgtcacggccgccgacacggtccgtctattactgtgcgagagtcaaggcggtacggaaaacccctacgaaacccccttatttcggaaacctacccgtgggggaccccaggggtaacccgtggtaccaccgtcaccctcacgccccc

SEQ ID NO: 425539 - DNA, 568 bp, Homo sapiens
  misc_feature: GZ8MTXP02I5SDR.25.87.H10.1.454.CMB.2.raw
  modified_base (366)..(366): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccgaggacggcctggagtggattgcgattgtctttcataggtgggagtgcctactacacgtccctcccctcaagagtcgagtcactgtttcggtnacacgtccacgcagcagttgtctctgacactgacgtctgccacggcccgccgaacgccggtctactattacgtgtcgcgaagcgtcgacgtccggtacgaaaaccccctacgtaaacccccttagttaccgacctaccggtacggggccccgaaggggtaaccccgtggtaccctacccggtcacccgtcgaacctcccccg

SEQ ID NO: 425540 - DNA, 623 bp, Homo sapiens
  misc_feature: GZ8MTXP02JRHEF.25.87.H10.1.454.CMB.2.raw
  modified_base (347)..(347): a, c, t, g, unknown or other
  modified_base (465)..(465): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggcctccgccacgcccccgagggacggcctggagtggattgcgtattgtctttcagtaggtgggagtgcctactacacgtccctccccctanaagacgtcgagtcacctatttcggtgacctacgtccaacgcacgctagttgtctcgtgacactgacgtctgtccaccgggcccgaccgaccgaccgggtccgttacttacgttaccgngttcggccgagtacgtcgacgggtccggtaaccggtaaaacccccttaccgaaaaccccctttacgtttaccgaacccgtacccgggtacgggggccccaaacgggggtaacccgttcggggtaccaacccggttccacccgttacaaccgtcccccg

SEQ ID NO: 425541 - DNA, 663 bp, Homo sapiens
  misc_feature: GZ8MTXP02IWVHG.25.87.H10.1.454.CMB.2.raw
  modified_base (222)..(222): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgtggggctggctccgccacgcccccgaggggaacggcctgggagtggattggcgtatttgtctttcattaggtgggtagtgccctaactacacgtcccctcccctcaagagtcgagtccacctgtttcggtgacacgtccacgcagctagttgtctctgactactgacgttctgtccgaccggcccgacccggaccgaccgggtcccgttaccttaacgtttaccgtggttacgccggtagtaacggttccgaaagggtcccggggttaaccggaaaaacccccccttacgtaaaaccccctttacgttttcggaaacccgtaccggttacgggggaccccgttaaacgggggaaccccggtttcggggtaccctaaaccccgggttccaaaccccggttccaacccggtcccccg

SEQ ID NO: 425542 - DNA, 608 bp, Homo sapiens
  misc_feature: GZ8MTXP02I617W.25.87.H10.1.454.CMB.2.raw
  modified_base (222)..(222): a, c, t, g, unknown or other
  modified_base (239)..(239): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtaccagctgcgtctgcaggagtcgagcccagggcaggtgaagccttcggagaccctgtccctcacctgctctgtctctggtnactccatcaccagtaangctcattacgtggggctggctccgccacgcccccgagggacggctggagtggattgcgtattgtctttcagtaggtgggagtcgcctactacacgtcccctcccctcaagacgtcgacgtccactgtttcggtcgacaccgtccacgcagctagttgtctctgacactgacgttctcgcgaccggcccgccgacgacccgggtccgtaccttagttacctgtcgcggagtacgtcgacggaccggtaccggtaaaaccccctaccgtaaaccccctttacgtttaccggaccgtacccggtacgggggcccgtaaacggggtaacccggtcggtaccgaccccggttccaacccgtcaccggtcccccg

SEQ ID NO: 425543 - DNA, 541 bp, Homo sapiens
  misc_feature: GZ8MTXP02INMON.25.87.H10.1.454.CMB.2.raw
  modified_base (222)..(222): a, c, t, g, unknown or other
  modified_base (249)..(249): a, c, t, g, unknown or other
  modified_base (345)..(345): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacnggggctggctccgccagcccccagggaacggcctggagtggattgcgattgtctttcatagtgggagtgcctactacacgtcccctcccctcaagngtcgagtcactgtttcgtgacaccgtccacgcagcagttgtctctgacactgacgtctgtcacggccgccgacacggccgtctattacctgtgcgagagtcgaggcggtacggaaaacccctacgaaaccccttactttacgacctaccgtcggggaccacgggaaccgtcggtaccaccgtcacctcacgtcccc

SEQ ID NO: 425544 - DNA, 640 bp, Homo sapiens
  misc_feature: GZ8MTXP02JL2CB.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccagggaggcctggagtggattgcgattgtctttcagtagtgggagtgccctactacagtcccctccccctcaacgagtcgagtcacctgtttcgggttgacacgtccacgcagtcagttgtctctgactactcgacgttctgtaccgacggcccgcccgacgaccgggtcccgtacttaacgtttacgtcgtacgccggagtacggtccgaacggggtccgggtaccggtaaaaaccccccgtactaaaaccccccgttaacttttaccggaacccgtacccgttacggggggaccccaacgggggtaaaccccgttggggttaaccccaacccgggttcccaaaccccgttccgaaccggtccccccg

SEQ ID NO: 425545 - DNA, 692 bp, Homo sapiens
  misc_feature: GZ8MTXP02GX1YJ.25.87.H10.1.454.CMB.2.raw
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctcgtggtnactcatcacagtatgctcattcgtggggctggctccgccaccgccccgagggacggccgtggagtggtattgcgtattgttctttgattaggtgggagtcgtacctaactacctacgttccccctcccccgtacaaacgtcgttacgacgtacctaaccgttacgttttcgggttacgaacccgtaccgtcccgaaccggcaacggtctagtttcgtccttcgtacgtaccaacgttcggtacccgttcgtacggttacccgacccgggtccccggacccgaaacgaccccggggtcccgttaaccttaagttacccgtggtacgaccggtaagacgttcgaccgggttccggaaaccccggtaaaaccccctaccttaaacccccgttcgttaacgaacccgtcccggtacgggacccgaacgggtaaccgtcggtacccacccggtcaaacccctccgaccgacccg

SEQ ID NO: 425546 - DNA, 648 bp, Homo sapiens
  misc_feature: GZ8MTXP02IIRQ7.25.87.H10.1.454.CMB.2.raw
  modified_base (249)..(249): a, c, t, g, unknown or other
  modified_base (368)..(368): a, c, t, g, unknown or other
  modified_base (378)..(378): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtaatgctcattacgnggggctggctccgccacgcccccgagggacggccgtggagtggagttgcgtattgtctttcagtaggtgggagtcgcctactactacgtcccctcccctacaagacgtcgagtctactntttcggttanacctaccgtccacgcacgctagttcgtctcgtacgtactacgtggaaccgttctcggtaccacccgggcccggacccgaccgtaccgggtcccgttacttacgttaaccgtggtacgcggaagtacgtacgacggtaccgggttaacccggaaaaccccctaaccctaaacccccgttactttacggaacccgtaccgtccgggggaaccctacgggggaacccgttcgggtacccacccggtacctacccgtacccgacggtacccccg

SEQ ID NO: 425547 - DNA, 608 bp, Homo sapiens
  misc_feature: GZ8MTXP02HMEXY.25.87.H10.1.454.CMB.2.raw
  modified_base (222)..(222): a, c, t, g, unknown or other
  modified_base (443)..(443): a, c, t, g, unknown or other
  modified_base (496)..(496): a, c, t, g, unknown or other
  modified_base (508)..(508): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtactagctctatactcggggcgtcgcgtccgccgacgaccccgaccggaaggggaccgtcggaggtggtagtgtcgagttgttcgtttctagtaggttgggtaggtcgtcctacctactacgtccctcccccctaccagacgtacgtacgtcgtaccacgtttcgtttcgacgaccgttaccgacgcgtacgcgtaagtttcggttcncctgtacgacttggacgtctcgtacgaccggccgtcccgacgacggtcccgtntattacgtcggngacgagacgtcgagtaccggtaacccgtaaccctacctaccctacgtcgacgaccgtcgggacgacggtaaccgtcgcgtacccactaccgtcgtacgcc

SEQ ID NO: 425548 - DNA, 559 bp, Homo sapiens
  misc_feature: GZ8MTXP02IFEMW.25.87.H10.1.454.CMB.2.raw
  modified_base (365)..(365): a, c, t, g, unknown or other
  modified_base (441)..(441): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtatgctcattactgggctggctccgccacgcccccgagggaaggcctggagtggattgcgtattgtctttcataggtggagtgcctactacacgtccctccctcaagagtcgagtcacctatttcgggtnacacgtccacgcagcagttgctctgacactcgacgtctagtccacggcccgccgaccacggcccgtctacgttacngtcgacgagacgtcgaggacggtacggaaaaccccctaccgaaccccctactttacgaccgtaccgtcgggggaccctaggggaacccgtggtccaccgtcacctccacgcccacccg

SEQ ID NO: 425549 - DNA, 592 bp, Homo sapiens
  misc_feature: GZ8MTXP02GZAC9.25.87.H10.1.454.CMB.2.raw
  modified_base (359)..(359): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccagggacggcctggagtggattgcgtattgtctttcagtagtgggagtgcctactacacgtccctcccctcaagagtcgagtcaccgtntttcggttgaccaccgtccaacgcagcagttcgtctctagactactgacgtctcgcgaccggccgccgaccacggccgttctacgttactgtcggcgagacgtcacgccgggtaacgtaaaaccccctaccaaacccccgttacgtttacgacccgtaccgttaccgggggaccctaagggggaaccccgttggggtacccacccggttccgaacccttccgaacgtcccccg

SEQ ID NO: 425550 - DNA, 553 bp, Homo sapiens
  misc_feature: GZ8MTXP02IEH20.25.87.H10.1.454.CMB.2.raw
  modified_base (222)..(222): a, c, t, g, unknown or other
  modified_base (346)..(346): a, c, t, g, unknown or other
  modified_base (360)..(360): a, c, t, g, unknown or other
  modified_base (371)..(371): a, c, t, g, unknown or other
  modified_base (448)..(448): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctccgccagcccccaggaggcctggagtggattgcgattgtctttcagtagtgggagtgcctactacacgtcccctccccctacaacgngtcgagtccacctntttccgggttnaccacgtccacgcagcctagtgtctctagacactcgacgtctgtcaccgccgccgaccacggtccgtctacttaccnggtgcgagcgtcgagtcggtacgaacccctacaacccctactttacgacctaccgtcggggacccaggggtaacccgtggtaccaccggtaccacctcacgcccc

SEQ ID NO: 425551 - DNA, 640 bp, Homo sapiens
  misc_feature: GZ8MTXP02H26SC.25.87.H10.1.454.CMB.2.raw
  modified_base (222)..(222): a, c, t, g, unknown or other
  modified_base (250)..(250): a, c, t, g, unknown or other
  modified_base (358)..(358): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgngggctcggctccgccacgccccgagggaacggctggagtggattgcgtattcgtcttcgtagtaggtgggagttcgacctaactacacgtcccctccccgtacaacgngtacgacgtaccaccgtgtttcgggtacaccgtaccgtccacgcaagtcgtagttcgtctcgtacgactacgtcgtacgtcgtcgtcgacgccgccgaccgacggtccgtactacgttacgtcgtaaaacgcgtagtacgtcgtacggtacggtaaccggtaaaccccgtaacccgtaaaccccttaccgttacgtaacccgtacccggtaccggggtacccggaaccgggtaaccggtccggtaaccgtacccgtaccgacccgttaccgaccgtaccccg

SEQ ID NO: 425552 - DNA, 546 bp, Homo sapiens
  misc_feature: GZ8MTXP02IW9WO.25.87.H10.1.454.CMB.2.raw
  modified_base (362)..(362): a, c, t, g, unknown or other
  modified_base (383)..(383): a, c, t, g, unknown or other
  modified_base (388)..(388): a, c, t, g, unknown or other
  modified_base (449)..(449): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactgggctggctccgccacgcccccgagggaacggcctggagtggattgcgtattgtctttcatagtggagtgcctactacagtccctcctcaagagtcgagtcacctattcggtnacacgtccacgcagctagttntcctntgacatcgcgtctgtccacggcccgaccgaccacggcccgttatacttactgtcgcgaagngtccaaggccggtacgaaaaccccttacaaccccttattacgaccacgtcggggaccaggggtaaccgtggtccaccgtcaccgtcacgccctaccg

SEQ ID NO: 425553 - DNA, 627 bp, Homo sapiens
  misc_feature: GZ8MTXP02GXLAM.25.87.H10.1.454.CMB.2.raw
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaatgctcattacgnggggctggcctccgccacgcccccgagggacggcctggagtggattgcgtattgtcttcagtaggtgggagtcgacctactaccacgttcccctcccctacgaagcgtcgagtaccacctagttttccggtgacctaccgtccacgtcagctagttcgtctctagactacgtcgacgttctcgtccgaccgggcccgaccgaccgtaccgggtcccgtacttacgttacgtgtacgcggaagtacggtcgacgggtaccgggtaaccgtaaaaccccctaccgtaacccccttagtttaccgacccgtaccggtcgggggtaccaacggggaaccgttcgggtacccaccggtccacccgtacgacggtacccccg

SEQ ID NO: 425554 - DNA, 555 bp, Homo sapiens
  misc_feature: GZ8MTXP02JZLC2.25.87.H10.1.454.CMB.2.raw
  modified_base (372)..(372): a, c, t, g, unknown or other
  modified_base (547)..(547): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccagggaggcctggagtggattgcgtattgtctttcataggtgggagtgcctactacacgtcccctcccctcaagacgtcgagtccactagtttccgggttanaccacgtcccacggccagcctagttgtctctgacactgacgtctgtcgaccggccgccgactaccgggctctattaccgtgtgcgagagtccgaggaccggtacggaaaccccctacgaaccccctatttcgactacccgtggggacccaggggaaccgtggtcaccgtcacccncgacgccg

SEQ ID NO: 425555 - DNA, 607 bp, Homo sapiens
  misc_feature: GZ8MTXP02HVHRH.25.87.H10.1.454.CMB.2.raw
  modified_base (221)..(221): a, c, t, g, unknown or other
  modified_base (236)..(236): a, c, t, g, unknown or other
  modified_base (246)..(246): a, c, t, g, unknown or other
  modified_base (368)..(368): a, c, t, g, unknown or other
  modified_base (390)..(390): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgccagatgggtcctgtcccagctgcgtctgcaggagtcgagcccagggcaggtgaagccttcggagaccctgtccctcacctgctctgtctctggtnactccatcacagtangctcattcgnggggctggcctccgccacgccccgaggacggctggagtgattgcgtattgtctttcagtaggtgggagtgcctaactacacgtccctcccctacaaagcgtcgatccactagttttcggtanaccacgtccacgcagctagttntctctgactactgactcgtgtcgaccggcccgaccgtacgaccggtcttactagttaccgtgtcgacgagacgtacacggaccgggtaaacctaaaaccccctacgtaaacccccttattaccggaccgtaacccggtcgggggaacccgaaccgggggtaaacccggttcgggtaacccctaccggtacccaaaccccttcgaaaccggtcccccg

SEQ ID NO: 425556 - DNA, 597 bp, Homo sapiens
  misc_feature: GZ8MTXP02GH3KM.25.87.H10.1.454.CMB.2.raw
  modified_base (222)..(222): a, c, t, g, unknown or other
  modified_base (366)..(366): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacggcccccgagggaacggcctggagtggattgcgtattgtctttcagtagtgggagtcgcctactacacgtccctcccctacgaagagtcgagtccactntttcgggtcaccacgtccaacgcagctagttgtctctgacactcgtacgtctgtccgaccggccgcccgacgaccggtcgtacttattacgtcgtgacgagacgtcgaggaccggtacggaaaaccccctacctaaacccccttacgtttacgacctacccggtacgggggacccgtaacgggggaacccgttcggacccgtacccgtccgaacctccgacggtacccccg

SEQ ID NO: 425557 - DNA, 563 bp, Homo sapiens
  misc_feature: GZ8MTXP02H4AX7.25.87.H10.1.454.CMB.2.raw
  modified_base (249)..(249): a, c, t, g, unknown or other
  modified_base (351)..(351): a, c, t, g, unknown or other
  modified_base (458)..(458): a, c, t, g, unknown or other
  modified_base (535)..(535): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacnggggctggctccgccacgcccccagggaacggcctggagtggattgcgtattgtctttcagtagtgggagttgcctaactactacgtccctcccctacaagngtcgagtcaccctagtttccggttagacctacgtccacgcagccagttgtctcgtagacctactgacgtctgtcacggccgccgacaccggccgttactattaccgngtacgacgtgagtcgagccggtacgaaacccctactaacccctcttacgacaccgcggggtacacggggtaacccgnggtaccaccggtcacccgtcaccgtccc

SEQ ID NO: 425558 - DNA, 568 bp, Homo sapiens
  misc_feature: GZ8MTXP02FXZTZ.25.87.H10.1.454.CMB.2.raw
  modified_base (223)..(223): a, c, t, g, unknown or other
  modified_base (243)..(243): a, c, t, g, unknown or other
  modified_base (563)..(563): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccctcacctgctctgtctctggtnactccatcacagtaatgctnattacgtggggctggctccgccacgcccccgaggaaggcctggagtggattgcgattgtctttcagtaggtgggagtgtcctacactacgtcccctcccctcaagcgtcgagtccactgtttcggtgactaccgtccacgcagtcagttgtctctagaccactcgacgttctgtccgaccggcccgacccgacaccgggtcctacttacgttactggtgacgagtacgttcgagtcgggtacgaaaacccctactaaaccccttacttcgaactaccgtcggggccaaggggaaccgtcggaccaccgtcacctacgacnccccg

SEQ ID NO: 425559 - DNA, 622 bp, Homo sapiens
  misc_feature: GZ8MTXP02GK36E.25.87.H10.1.454.CMB.2.raw
  modified_base (222)..(222): a, c, t, g, unknown or other
  modified_base (458)..(458): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggcctccgccacgcccccgagggaacggcctggagtggattgcgtattgtctttcataggtgggatgcctactacacgtccctcccctcagagtcgagtccactgtttcggtgacacgtccacgcagctagttgtctcgtcgacacgtcgtacgtctgtccgaccggccgacccgaccgaccggtccgtacttacgttacgngtgacgaggtacgtacgacggtcccggtaaccggtaaaaccccctaccgtaaaccccctttacgtttaccggaaccgtacccgggttacgggggaccccgtaacgggggtaacccgttcgggtacccgtaccccggttaccacccgttaccgaaccgtcccccg

SEQ ID NO: 425560 - DNA, 550 bp, Homo sapiens
  misc_feature: GZ8MTXP02FM6KJ.25.87.H10.1.454.CMB.2.raw
  modified_base (383)..(383): a, c, t, g, unknown or other
  modified_base (397)..(397): a, c, t, g, unknown or other
  modified_base (409)..(409): a, c, t, g, unknown or other
  modified_base (414)..(414): a, c, t, g, unknown or other
tcagactgtacagtcacgaccggtgctcgatttagcagtactgcgttgcgtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccaggaggcctggagtggattgcgattgtctttcatagtggagtgcctatacagtccccctccctcaagagtcgagtcaccatttcggttgaccacgtcacgcagcagttgctntgacacttgacgtntagtcacggccncgacncgccgtcattactgtgcgagagtcgagtcggtacggaaaaccccctacgaaaccccttactttacgacccgaaccctgggggaccccaagggggaaacccttcgggtaccacccggtttacctcgaacgtcccccg

SEQ ID NO: 425561 - DNA, 643 bp, Homo sapiens
  misc_feature: GZ8MTXP02JMQRL.25.87.H10.1.454.CMB.2.raw
  modified_base (244)..(244): a, c, t, g, unknown or other
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgcctctgtctctggtgactccatcaccagtaatgctnattacgnggggctggctccgccacgcccccgagggacggcctggagtggattgcgtattgtctttcagtaggtgggagtgacctactacacgttccctccccctacaagcgtcgagtccacctgtttcggtgactacgtccacgcagctagttgtctctgacactgaccgtctcgtaccaccgggcccgaccgtaccgacccgggtacccgttacgtactttaacgtcggttcgaccggtagacggtccgaacggggtccgggtaacccggaaaacccccttaccgtaaacccccgtttacgtttaccggaacccgttacccggtacgggggaaccccgtaacgggggaacccgttcggtacccgaacccggttccaaccccgttcgacgtaccccccg

SEQ ID NO: 425562 - DNA, 562 bp, Homo sapiens
  misc_feature: GZ8MTXP02JUK6Z.25.87.H10.1.454.CMB.2.raw
  modified_base (347)..(347): a, c, t, g, unknown or other
  modified_base (359)..(359): a, c, t, g, unknown or other
  modified_base (367)..(367): a, c, t, g, unknown or other
  modified_base (425)..(425): a, c, t, g, unknown or other
  modified_base (441)..(441): a, c, t, g, unknown or other
  modified_base (450)..(450): a, c, t, g, unknown or other
  modified_base (558)..(558): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccagggacggcctggagtggattgcgattgtctttcataggtgggagtgcctactacacgtccctccccctcaagngtcgagtcactntttcggtnaccacgtccacgcagctagttgtctctgtacactgacgtctgtcaccggccgccgacnccggccgtctattacngtgcgtagngtacgagacggtacggaaaacccctactaacccctacgttcgaaccgccgtacggggcccgaaggggtaacccgtcgggtaccctaccggtcctaacccgtcgacccncccg

SEQ ID NO: 425563 - DNA, 541 bp, Homo sapiens
  misc_feature: GZ8MTXP02IDFUZ.25.87.H10.1.454.CMB.2.raw
  modified_base (221)..(221): a, c, t, g, unknown or other
  modified_base (345)..(345): a, c, t, g, unknown or other
  modified_base (358)..(358): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcacagtaatgctcattacgtggggctggctccgccacgcccccagggacggcctggagtggattgcgtattgtctttcataggtgggagtgcctactacacgtccctcccctacaagngtcgagtcacctntttcggtgacacgtccacgcagctagtgtctctgacactgacgtctgtcacggccgccgaccgacggtccgtctattactgtgcgagagtcacggcggtacgaaaacccctacctaaccccttactttcgacctaccgtcgggaccaacgggaaccgtcggtcaccggtcaccctcgacgccc

SEQ ID NO: 425564 - DNA, 601 bp, Homo sapiens
  misc_feature: GZ8MTXP02G5V8X.25.87.H10.1.454.CMB.2.raw
  modified_base (222)..(222): a, c, t, g, unknown or other
  modified_base (369)..(369): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgcccccgagggacggcctggagtggattgcgtattgtctttcagtagtgggagtgcctactacacgtccctcccctacaagagtcgagtcactgtttcggtnaccacgtccacgcagctagttcgtctcgtgacctacgtcgacgttctcgtaccgaccgggcccgaccgaccgaccgggtccgttacttacgttaccgtgtgcggtaagacgtcgaggccggtaacggaaaaccccctacctaaaccccgttacgtttacgaaccgtaacccgtcgggggaccctaacggggaacccgtcggtaccacccggtccaccctccgacgtaccccg

SEQ ID NO: 425565 - DNA, 614 bp, Homo sapiens
  misc_feature: GZ8MTXP02JE8BO.25.87.H10.1.454.CMB.2.raw
  modified_base (222)..(222): a, c, t, g, unknown or other
  modified_base (237)..(237): a, c, t, g, unknown or other
  modified_base (248)..(248): a, c, t, g, unknown or other
  modified_base (375)..(375): a, c, t, g, unknown or other
  modified_base (464)..(464): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtangctcattacgnggggctggctccgccacgccccgagggacggcctggagtggatgcgtattgtctttcagttaggtgggagtcgcccgtactacacgtcccctccccctacgaagacgtcgagtccactgtttcggtnacctacgtccacgcagctagttgctctgacactggactcgtacgtccgaccggcccgaccgacgaccgggtccttcttaactttaccgnggtacgacggtagtacgtcgacgggtaccggtaaaccccgtaaaacccccttacctaaaccccgttacgttaccggaacccgtaccggtccggggaacccgtaacggggtaaccgtcggtacccaccgtaccaccctacgaccgtacccc

SEQ ID NO: 425566 - DNA, 625 bp, Homo sapiens
  misc_feature: GZ8MTXP02GL2B2.25.87.H10.1.454.CMB.2.raw
  modified_base (241)..(241): a, c, t, g, unknown or other
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtatgctnattacgngggctggcctccgccacgcccccgagggacggcctggagtggattgcgtattgtctttcagttaggtgggagtgtaccctaactacacgttcccctccccctacaaagacgtcgacgttccaacctagttttccggtcgaccgtaccgtacccacggtcagtctagtttctctctcgactactcgacgtctcggtccacgggcccgaccgacgaccggtcctatactttacgtggtgacgtaagcgttacgacgggaccggtaaccggtaaaaccccctaccgtaaaccccttacgtttacgacccgtaccggtcgggggacccgaacggggtaaccggttcgggtaccctacccggtcacccgtcgacgtcccccg

SEQ ID NO: 425567 - DNA, 669 bp, Homo sapiens
  misc_feature: GZ8MTXP02IDT8Y.25.87.H10.1.454.CMB.2.raw
  modified_base (222)..(222): a, c, t, g, unknown or other
  modified_base (238)..(238): a, c, t, g, unknown or other
  modified_base (249)..(249): a, c, t, g, unknown or other
  modified_base (379)..(379): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtangctcattacgnggggctggctccgccacgcccccgagggaacggccgtggacgtggtattggcgtattgtctttcagttagtgggagtcgcctacgtactacgtccctcccctcagagtcgacgtaccactagtttcggtnaccacgtccacgcagctagttcgtctctgactactcgacgtctgtccgacggcccggccgaccgaccgggtcctaccttacgtttaaccgtggttacggaccggtaagtacggtccgaacgggtaccgggttaacccggtaaaaaccccccgttactaaaccccccgttacgttttaccggacccgttaacccggacgggggtaaccccgaacgggggtaaccccggttccggggttaacccaacccccggttaccgtaaacccccgtttccgaaaccggttaccccccg

SEQ ID NO: 425568 - DNA, 656 bp, Homo sapiens
  misc_feature: GZ8MTXP02G5JM1.25.87.H10.1.454.CMB.2.raw
  modified_base (191)..(191): a, c, t, g, unknown or other
  modified_base (249)..(249): a, c, t, g, unknown or other
  modified_base (406)..(406): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtgactccatcaccagtatgctcattacgnggggctggcctccgccacgcccccgaggggaacggccgtggagtggattggcgtagttcgttctttacgagttaggtgggtacgtcgtaccctactaccaccggttcccctaccccctacgaacgtacgtaccgagttccaactcgttttccggtanaccgtaccgtccacgcacggctagttcgtctcgtagacctacgtcgacgttcgtgacccgaccgggcccgacccggtaacgacccgggtccttacttacgttacgcggttagaccgaggtacgtcgaaccgggacggtaacccgaaaacccctaccgtaaaccccttacgttaccgaccgtacccggtacgggggaccctaacggggaacccgtagacccgtaaccgtccaaccgtcgaaccgtcccccg

SEQ ID NO: 425569 - DNA, 596 bp, Homo sapiens
  misc_feature: GZ8MTXP02F7K5R.25.87.H10.1.454.CMB.2.raw
  modified_base (371)..(371): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccacgcccccgagggacggcctggagtggattgcgtattgtctttcagtaggtgggagtcgcctactacacgtccctcccctacagagtcgagtccactgtttcggtnacaccgtccacgcagctagttcgtctcgtgactactgacgtctgtcgaccggccgaccgacgaccgggccttacttaagttccnggttcgacggagacgtcgaggtccggtaccggaaaaccccctacaaacccccgttacgtttacggaaccctaccggtacgggggacccgtaacggggtaacccgtcgggtaccacccggttccaaccgtcgacgtcccccg

SEQ ID NO: 425570 - DNA, 640 bp, Homo sapiens
  misc_feature: GZ8MTXP02GZGSB.25.87.H10.1.454.CMB.2.raw
  modified_base (223)..(223): a, c, t, g, unknown or other
  modified_base (285)..(285): a, c, t, g, unknown or other
  modified_base (306)..(306): a, c, t, g, unknown or other
  modified_base (514)..(514): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactccatcaccagtatgctcattacgtggggctggcctccgccacgccccgaggacggccgnggagtgatgcgtattgtcttnagtaggtgggatcgacctactacgacgttcccctacccctacgaagtacgtccgagtccctaaccgtagttttaccgggttcaacccgtaaccgttcccaaccgctaacggtcctaaggttttcgccttcgtacgacctacgtcgtaccgttcgtcgtaccgaccgggccccgacccgaacgtaccgggtccctacttagtttaccgnggtacgacgagtacgtacgacgggaccgtaacccgtaaacccctaccgtaacccttcgtaccgaccgtaccggtacggaccgaacggtaaccgtcggtacccaccgtccaccgtacgaccgtcccg

SEQ ID NO: 425571 - DNA, 673 bp, Homo sapiens
  misc_feature: GZ8MTXP02HHVP3.25.87.H10.1.454.CMB.2.raw
  modified_base (223)..(223): a, c, t, g, unknown or other
  modified_base (387)..(387): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactccatcaccagtaatgctcattacgtggggctcggcctccgcgacgccccgagggacggctggagtggattgcgtattcgttcttcagtaggtgggagtgaccctataccgacgttcccctaccccctacgaagcgttacgcgttaccaccttgtttcggtnaccgacgtccagacacgctaggtttcgtctacgttagaaccgtcgttacgccgttcgtacggttccgaacccgggtcccaccccggaaacggacccggggttccctatttaaccgtttaccgtgggttccgacgggaaagtcgttccggaacggtacccgggggtaaccgtaaaaaccccctaccgtaaaccccctttacgttaacgaccgtaacccgggtcgggaccgtaaaacgggggtaaccgttcggtacccgaaacccgtctacccgacgacccgaccccg

SEQ ID NO: 425572 - DNA, 639 bp, Homo sapiens
  misc_feature: GZ8MTXP02HPCVH.25.87.H10.1.454.CMB.2.raw
  modified_base (222)..(222): a, c, t, g, unknown or other
  modified_base (248)..(248): a, c, t, g, unknown or other
  modified_base (379)..(379): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtaatgctcattacgnggggctggctccgccacgcccccgagggacggccgtggagtggatgcgtattgtctttcagttaggtgggtagtcgacctactacaccgttccctccccctagaacgtgtcgagtccactagtttcggtanacctaccgtaccacgcagctagttcgtctcgtcgactcgtcgtacgttctcgtccgaccggcccgaccgaccgaccgggtcctacttagttaccgtgtcggacgagtacgtcgacgggtaccggtaacccggaaaaccccctaccgtaaacccccttactttaccggaacctacccggggtacgggggacccgtaaacgggggtaacccggttcggtaaccccgtaccccggtacctacccgtaccgtaaccggtccccc

SEQ ID NO: 425573 - DNA, 675 bp, Homo sapiens
  misc_feature: GZ8MTXP02F8ILR.25.87.H10.1.454.CMB.2.raw
  modified_base (222)..(222): a, c, t, g, unknown or other
  modified_base (306)..(306): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgtgggctggcctccgccgacgcccccgagggacggccgtggagtggatgcgtattgtcttnagtaggtgggatcgacctactacacgtccctcccctacgaagacgtacgacgtaccaaccttgtttcggtacgacgtaccgtccacgcagtctagtttcgtctctacgactactcgacgttctgaccgaccgggcccgacccgacgtaccgggtcccttacgttaacgtttccgtggtacggacggtaacggtacggttaccgacggggtaccccggggttaaaccccggtaaaaaccccccttacccgtaaacccccgtttaacgtttaccggaaacccgtacccggggttacgggggaccccgtaaaagggggaaccccgtttacggaccctacccggtacccaccgttaccgaccggtaccccccg

SEQ ID NO: 425574 - DNA, 677 bp, Homo sapiens
  misc_feature: GZ8MTXP02IMHK5.25.87.H10.1.454.CMB.2.raw
  modified_base (250)..(250): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgnggggctggctccgccacgcccccagggaacgggcctggagtggattgcgattgtctttcagtagtgggagtgcctactacagtcccctcccctcaagagtcgagtcacctgtttcggtgaccaccgtccacgcacgctagtgtctctgacacgtcgtaccgttctcggtccaccgggcccgacccggacgtaacccggggtccccttacgttaacgtttaacccgtgggttacgaccgggtaaggtaacggttccgaaacgggtcccgggggttaaacccgggtaaaaacccccccttaccggtaaaacccccctttacgttttaacgggaaccctaacccgggttacggggggaccccaaaagggggtaaccccgttcggggtaccctacccggttaccaccccgtttaccgaacggtaccccccg

SEQ ID NO: 425575 - DNA, 573 bp, Homo sapiens
  misc_feature: GZ8MTXP02H1VV6.25.87.H10.1.454.CMB.2.raw
  modified_base (191)..(191): a, c, t, g, unknown or other
  modified_base (249)..(249): a, c, t, g, unknown or other
  modified_base (334)..(334): a, c, t, g, unknown or other
  modified_base (364)..(364): a, c, t, g, unknown or other
  modified_base (373)..(373): a, c, t, g, unknown or other
  modified_base (472)..(472): a, c, t, g, unknown or other
  modified_base (554)..(554): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtgactccatcaccagtatgctcattacgnggggctggcctccgccacgcccccgagggacggccgtggagtggattgcgtattgtctttcagtaggtgggagtcgcctactacncgtccctcccctcaagcgtcgagtcacctntttcggtanaccacgtccacgcacgtctagttcgtcctcacgactacgtcgtacgtctcggtccgaccggcccggaccgaacctccggggtccttacttagttctggngacgtagagtcgagccggtaaccgaaacccctacctaccctattcgaacgtccgcgggaccacggggtaaccgtcggtaccnccgtccacctcgacgcccc

SEQ ID NO: 425576 - DNA, 612 bp, Homo sapiens
  misc_feature: GZ8MTXP02GOVK9.25.87.H10.1.454.CMB.2.raw
  modified_base (222)..(222): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgccccaggacggcctggagtggatgcgtattgtctttcagttagtgggatcgcctactacacgtccctcccctacgaagcgtcgagtccactgtttcggtgactacgtccacgtcagctagttcgtctctgacctactcgactcgtgtccgaccggccgacccgacgaccgggtcctcttacttacgtggtagcggagacgtacgaggtaccggtaacggtaaaaccccctacccgtaaaccccttacgtttacggacccgtaccggtacgggggacccgaacgggggtaacccggttcgggtacccgtacccggtaccctaacccgttccgaccggtacccccg

SEQ ID NO: 425577 - DNA, 544 bp, Homo sapiens
  misc_feature: GZ8MTXP02FIMJN.25.87.H10.1.454.CMB.2.raw
  modified_base (355)..(355): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccagcccccaggaaggcctggagtggattgcgattgtctttcatagtgggagtgcctactacacgtccctccccctcaagagtcgagtcaccntttcggtgacacgtccacgcagcagttgtctctgacactgacgtctgtcgacggcccgccgacacgggcccgtctattactgtgcgagagtcagccggtacggaaaaccccctacgaaacccccttactttcgacacccgtgggggcccaaggggaaccgtgggtaccaccggtcacccgtcacgcccc

SEQ ID NO: 425578 - DNA, 654 bp, Homo sapiens
  misc_feature: GZ8MTXP02H5M5P.25.87.H10.1.454.CMB.2.raw
  modified_base (222)..(222): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcattacgtggggctggcctccgccacgcccccgagggaacggcctggagtggattggcgtattgttctttcagttaggtgggagtgcctactacacgtcccctcccctacgaacgagtcgtacgtcctacctgttttcgggttgacctaccgtcccacgctagctagttgtctctgactcgttcgacgttcgtcgtccgaccgggcccgcccgaccgaccgggtccgttccttacgttacgtggtacgcggtaggacgtaccgacgggaccgggttaacccggaaaacccccttacccgtaaacccccgtttacgtttaccgaaccgtacccggttacgggggacccggtaacggggtaacccggtaccgggttacccgaacccggtccaaccccgttcgaccggtacccccg

SEQ ID NO: 425579 - DNA, 599 bp, Homo sapiens
  misc_feature: GZ8MTXP02HZO0P.25.87.H10.1.454.CMB.2.raw
  modified_base (222)..(222): a, c, t, g, unknown or other
  modified_base (375)..(375): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgcccccgagggagggcctggagtggattgcgtattgtctttcagtagtgggagtgcctactacacgttcccctcccctcaagtagtcgagtccacctagttttcggtnaccaccgttccacgcacgctagttgtctacgtcgactactgacgttctcgtccgacggcccgccgaccgacggtccgttctattacgtgtcgcgacgagtccgaggtccgggtacgaaaaccccctacgtaacccccgttactttcggaacctaccggttcggggaccctaacgggggtaaccgtcgggttaccacccggttaccacccgttcaaccggccccg

SEQ ID NO: 425580 - DNA, 586 bp, Homo sapiens
  misc_feature: GZ8MTXP02JE3EY.25.87.H10.1.454.CMB.2.raw
  modified_base (222)..(222): a, c, t, g, unknown or other
  modified_base (249)..(249): a, c, t, g, unknown or other
  modified_base (346)..(346): a, c, t, g, unknown or other
  modified_base (394)..(394): a, c, t, g, unknown or other
  modified_base (453)..(453): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgngggctggctccgccacgccccgaggacggctggagtgatgcgtattgtcttcagtacggtgggagtcgacctactacacgtccctcccctacgaagngtacgacgtaccactacgtttcggttacgaaccgtacgtccacgcganctagttctctctagacactgactctgccacggccgccgacaccggctacttagttacgnggtcgagagtacgacgacggtaccggtaaccgtaaaacccctaccgtaaacccttacgtaccgaccgtaccggtaccggggaccgaacggggtaaccgtcggtaccgtaccgtaccaccgtacgaccgtcccg

SEQ ID NO: 425581 - DNA, 657 bp, Homo sapiens
  misc_feature: GZ8MTXP02G0HRW.25.87.H10.1.454.CMB.2.raw
  modified_base (368)..(368): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaacggcctggagtggattgcgtattgtctttcatagtgggagtgccctactacacgttcccctccccctcgaacgagtcgagtcctacctnttttcgggtcgtaccaccggttcccacggcaacgctagtttgtcctacgttacgacctaactcgaaccgttcgttagtcccgacggccccgtaccggaccgtaccgggtcccgttactacgtttacgtcggtcgaccggtagacgttccgaggaccgggttaacgggaaaaccccctacggaaaccccccttaactttaccggaaccttacccggtacgggggtacccgaacgggggtaacccgtcgggtacccgtaacccggtccaacccgttccgacggtacccccg

SEQ ID NO: 425582 - DNA, 660 bp, Homo sapiens
  misc_feature: GZ8MTXP02HX8ND.25.87.H10.1.454.CMB.2.raw
  modified_base (248)..(248): a, c, t, g, unknown or other
  modified_base (332)..(332): a, c, t, g, unknown or other
  modified_base (351)..(351): a, c, t, g, unknown or other
  modified_base (372)..(372): a, c, t, g, unknown or other
  modified_base (463)..(463): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtgactccatcacagtaatgctcattacgnggggctggcctccgccacgcccccgagggaacggccgtggagtggattgcgtattgtctttcataggtgggagtgcctactacncgtcccctcccctacaagngtcgagtccactgtttcgtanaccaccgtccacgcacggctagttcgtctctgactacgtgacgtctcggtcaccggccgacccgacgaccgggtccttactacgttaccgngttcgaccggtagtacgttccgaagggtcccgggttaaaacccggtaaaacccccttaaccgtaaccccccgtttaaacgtttccggaaaaccccgtcccggggttacgggggacccccgaaacggggggttaaacccccgttcggggttaaccccaccccgggttaccgaccccctttaccgaccggtaccccccg

SEQ ID NO: 425583 - DNA, 577 bp, Homo sapiens
  misc_feature: GZ8MTXP02F1FLL.25.87.H10.1.454.CMB.2.raw
  modified_base (377)..(377): a, c, t, g, unknown or other
  modified_base (446)..(446): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtatgctcattacgtggggctggctccgccacgcccccagggaaggccgtggagtggattgcgtatttgtcttttcagttggtgggtagtcgacctactacacgttcccctcccctacgaagtgtcgagtcactgtttcggtnacacgtccacgcagctagttgtctctgacactcgacgtctgcgacgccgaccgcaccgggctctagtcngtcgcgagcgtcgaggtccggtacgaaaacccctactaaccccttacgttacgacctaccggtcggggacctaacgggggtaacccgttcggtaaccgacccggttccgacccttacgacggtaacccccg

SEQ ID NO: 425584 - DNA, 604 bp, Homo sapiens
  misc_feature: GZ8MTXP02H55QS.25.87.H10.1.454.CMB.2.raw
  modified_base (222)..(222): a, c, t, g, unknown or other
  modified_base (248)..(248): a, c, t, g, unknown or other
  modified_base (304)..(304): a, c, t, g, unknown or other
  modified_base (374)..(374): a, c, t, g, unknown or other
  modified_base (421)..(421): a, c, t, g, unknown or other
  modified_base (455)..(455): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtaatgctcatacgngggctgcctccgccacgccccgagggacggctggagtggattgcgtattgtctttnagtaggtgggatgcctactacacgtccctcccctacaagacgtcgacgttccaccttagtttccggttanaccgtaccgtccacgcaggctagttgtctctagactacgtgacgtcngtcacggccgaccgacaccggtctactattacgngtgacgtagacgtacgaggtccggtaaccgtaaaacccctacctaaaccccgttacgttacgaacccgtacccggtacgggggaacccgaacgggggtaacccgttcgggaaccctacccggttacaaccccgtcgtaaacccgccccg

SEQ ID NO: 425585 - DNA, 628 bp, Homo sapiens
  misc_feature: GZ8MTXP02GNKCH.25.87.H10.1.454.CMB.2.raw
  modified_base (222)..(222): a, c, t, g, unknown or other
  modified_base (441)..(441): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacgtgggctggctccgccacgccccgaggacggcctggagtgatgacgtattgttctttcgagttaggtgggtaacgtcgaccttaactacgtacgtccccttaccccgtacaaacgtacgtaccgtagtccaaccgtagtttccgggttagaccgtaccgtaccaacggtcaacgctagtttcgctcgtagaaccngtcgtacgtcgtcgtcaccgggccgtcccgaacgaccggtccgtacttaagtttccgcgtgccgagtaacgtcgacgggtcggttaacccggaaacccttacctaccccgttacgttacgaccgtaccgtacgggggcccaacggggtaaccgtcgtaccgcccggtacaccctcgaccgtaccccg

SEQ ID NO: 425586 - DNA, 641 bp, Homo sapiens
  misc_feature: GZ8MTXP02HVAG2.25.87.H10.1.454.CMB.2.raw
  modified_base (358)..(358): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtgactccatcaccagtaatgctcattacgtggggctggcctccgccacgcccccgaggggaacgggcctgggagtggattggcgtatttgtctttcattaggtgggtagtcgacctactaccacgtcccctccccctanaagagtcgagtccaacctgttttcgggtcaccaccgtccaacgcagctagttcgtctctagactactcgtacgtctacgtccgaccgggccgtcccggaacctaccggggtcccttacttacttaccgtggttacgccggaagtacggttcgacgggtaccgggttaaccggaaaacccccttacccgtaaaccccttacgtttacgacccgtaccggttcggggacccgaaggggtaacccggttcggtacccgaccggtacccaccttcgaaccgtccccg

SEQ ID NO: 425587 - DNA, 724 bp, Homo sapiens
  misc_feature: GZ8MTXP02HJCJH.25.87.H10.1.454.CMB.2.raw
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtgactccatcaccagtatgctcattacgnggggctggctccgccacgcccccgagggacggcctggagtggattgcgtagttcgtctttacgagttacggtgggagtcggcccttaactacaccggttccctccccccgtacgaaagcgtcgtaactccaacctgttttccgggttagacctaccgttccaacggcacggtctagtttcgtctacgttcggaacctacgttcggaacgttctcgtacccgaccgggtcccgaccgtaaccgccgggttcctaccgttaacgttaccgtggtacgacggtaacggtacgttccggaacgggtacccgggttaaacccggtaaaacccccccttaacgttaaaccccccgtttaacggtttaccgaaccccggttacccgggttacgggggtaacccccgaaaggggggtaaccccgttcgggttaccccgtaacccccggtttaccaacccccgtaccgtaaacccggtccccccg

SEQ ID NO: 425588 - DNA, 617 bp, Homo sapiens
  misc_feature: GZ8MTXP02GBIHW.25.87.H10.1.454.CMB.2.raw
  modified_base (222)..(222): a, c, t, g, unknown or other
  modified_base (241)..(241): a, c, t, g, unknown or other
  modified_base (306)..(306): a, c, t, g, unknown or other
  modified_base (373)..(373): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattacgtgggctggctccgccacgcccccgagggacggccgtggagtggatgcgtattgtctttnagtaggtgggtagtcgtacctactacacgtccctcccctacgaagacgtcgagtcactgtttcggtnacacgtccacgcagctagttcgtctctcgacctacgtcgtacgttctcgccgaccggcccgaccgaccgaccgggtcccgttacttaacgttaccgtggtacgacggtaggacgtcgaacgggccggttaacccggaaaaccccctaccgtaaacccctttacgttacgaaccgtacccggtacggggaccgaacggggtaaccgttcgggaccctacccggtacacccgtacgaccgtccccg

SEQ ID NO: 425589 - DNA, 642 bp, Homo sapiens
  misc_feature: GZ8MTXP02HDBD0.25.87.H10.1.454.CMB.2.raw
  modified_base (222)..(222): a, c, t, g, unknown or other
  modified_base (237)..(237): a, c, t, g, unknown or other
  modified_base (410)..(410): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtangctcatacgtgggctggctccgcacgccccaggacggctggagtggattgcgtattgtctttagataggtgggagtcgccctaactaccacgtcccctcccctacgaagagtcgacgtccaacgtgtttccggtagaaccgtaccgtccacgtccaagcctagttcgtacctntacgacctactcgaccgttctcgtaccaccggggtcccaccggaccgaccggtcccgtacttacgttacgtgtcggacggtaagacgtccgagggtccgggttaaacccggtaaaaccccctaccgtaaacccccgtttaacgtttccgaaacccgtacccggtacggggaccccggtaaaggggtaacccgtcggtaccaccccggttcacccgttcccgacggtaccccc

SEQ ID NO: 425590 - DNA, 633 bp, Homo sapiens
  misc_feature: GZ8MTXP02F8U33.25.87.H10.1.454.CMB.2.raw
  modified_base (401)..(401): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtaatgctcattacgtggggctggctccgccacgcccccgagggaacggcctggagtggatgcgtattgtctttcagtaggtgggagtgtacctactacacgtcccctcccctacaagacgtcgacgtccacctgtttcggtagacctacgtccacgcagctagttcnctctgactactcgtacgtctgaccacgggcccgccgaaacgccggtcccgtacttaacgttacgtcggtagacgtacgggtaagtccgaacgggtccgggtaaacccggaaaacccccttaccctaaaacccccgttacgtttaccggaaccgtacccggttacgggggacccgtaaacgggggaacccgtcgggtacccaacccggtccacccgttacgaccgtacccccg

SEQ ID NO: 425591 - DNA, 590 bp, Homo sapiens
  misc_feature: GZ8MTXP02GU8Q9.25.87.H10.1.454.CMB.2.raw
  modified_base (222)..(222): a, c, t, g, unknown or other
  modified_base (250)..(250): a, c, t, g, unknown or other
  modified_base (366)..(366): a, c, t, g, unknown or other
  modified_base (373)..(373): a, c, t, g, unknown or other
  modified_base (393)..(393): a, c, t, g, unknown or other
  modified_base (448)..(448): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgnggggctggctccgccacgcccccgagggaacggcctggagtggattgcgtattgtctttcagtaggtgggtagtcgcctaactacacgtcccctcccctcaagagtcgagtcactntttcgtnacacgtccacgcagcagttntctctgacactgacgtctgcacggcccgccgacgaccggtccgtactagttaccngtgcgagacgtcgaaggcggtacggaaaaccccctaccgtaaacccccttacgtttacgaaccgtaccgtacgggggaccctaacgggggtaaacccgttcggtacccgaaacccggttccaaccctccgaacggtcccccg

SEQ ID NO: 425592 - DNA, 619 bp, Homo sapiens
  misc_feature: GZ8MTXP02IU47K.25.87.H10.1.454.CMB.2.raw
  modified_base (222)..(222): a, c, t, g, unknown or other
  modified_base (249)..(249): a, c, t, g, unknown or other
  modified_base (380)..(380): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgnggggctggcctcccgccacgcccccgagggacggccgtggagtggattgcgtattgtctttcagttaggtgggtagtcgcctactaccacgttcccctccccctacaagagtcgagtccactgtttcggtnacaccgtccacgcagcagtttcgctctagaccactcgacttctcgaccgaccggcccgaccgacgaccgggtccttacttaagttccgtgtcgacgaggtacgtccgaacgggtccggtaacccggaaaaccccctacctaaacccccgttcgtttaacgacccgtacccggtacgggggaccccaagggggtaacccgtcgggtacccacccggtccacccgtaccgacggtaccccc

SEQ ID NO: 425593 - DNA, 544 bp, Homo sapiens
  misc_feature: GZ8MTXP02JSK2L.25.87.H10.1.454.CMB.2.raw
  modified_base (223)..(223): a, c, t, g, unknown or other
  modified_base (387)..(387): a, c, t, g, unknown or other
  modified_base (405)..(405): a, c, t, g, unknown or other
  modified_base (422)..(422): a, c, t, g, unknown or other
  modified_base (440)..(440): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatggggtcctgtcccagctgcgtctgcaggagtcgagcccagggcaggtgaagccttcggagaccctgtccctcacatgctctgtctctggtnactccatcaaccagtaatgctcattactggggctggctccgccagcccccgagggacgggcctggagtggattgcgatttgtcttttacataggtgggagtgcctctactgtcccccctcctcagagtcgatcacctatttcgtgacacgtcacgcagcagttntctctgacactgacgtcngtcacggccgtccgacncgggcctactattaccgngtgcgagagtcgacgacgggtacgaaaaccccctacaaacccccgttattacgaccaccgtgggggccaacgggtaccgtcggtcacccgtcaaccctcaaccg

SEQ ID NO: 425594 - DNA, 623 bp, Homo sapiens
  misc_feature: GZ8MTXP02FUE1P.25.87.H10.1.454.CMB.2.raw
  modified_base (223)..(223): a, c, t, g, unknown or other
  modified_base (355)..(355): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctcgtggtnactcatcaccagtatgctcattacgtggggctcggcctccgccacggcccccgaggggaacggcctgggagtggattgcgtattgtctttcagtaggtgggagtcgtcctactacaccgtccctccccctanaagcgtacgagtcctactagtttcggtagacctaccgtccacgcagtctagttcgtctacgtgactacgtcgacgttctcgtaccgacccggccgcccgacgaccgggtccttattacgttaccgtggtcgcggaaggtgttaccgacgggtaccggggtacctaaaacccccttcaaaacccccgtttgttacggacccgtaccggtacgggggacccaacgggggtaaccgttcggacccgtaaccgtcaccgtcaaccggtcccc

SEQ ID NO: 425595 - DNA, 680 bp, Homo sapiens
  misc_feature: GZ8MTXP02GBXZG.25.87.H10.1.454.CMB.2.raw
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagtctttcggagaccctgtccctcacctgctctgtctctggtnactccatcaccagtatgctcattacgtggggctggctccgccacgcccccgagggacggcctggagtggattgcgtattgttctttcagttaggtgggatcgtaccctacgtacctacgtcccctcccctacgaacgtagtaccgtacgtaccaaccgttagtttcgggtacgtaaccctacccggttacccaacggccaaacggtcgtaaacggtttcgtaccttcgtacggaaccttaccgtcgtaacccgttccgttggtaccccgaccggggccccgacccggaacgacccgggtcccgttacttacgtttaccgtcgtggacgaagtacgtcgacggtaccggtaacccgtaaaacccctaccgttaaaccccttacgttacggaaccgtacccgtacggggacccaacgggggtaaccgtcggtacgacccgtcaccctcgaccgtacccc

SEQ ID NO: 425596 - DNA, 641 bp, Homo sapiens
  misc_feature: GZ8MTXP02IB41R.25.87.H10.1.454.CMB.2.raw
  modified_base (310)..(310): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtatgctcattacgtggggctggcctccgccacgcccccgaggggacggccgtggagtggagtgcgtattgtctttnagtggtgggagtgacctactacctacgtccctcccctacgaacgtagtaccgagtacctaccttagttttcggttacgaccgtaccgtaccacgcgagccgtagttcgtctcgtacgacctacgtcgtacgttctcgtccgaccggcccgccgaccgaccgggtccttacttacgttacgtgtcgacggtagtacgtacgaggtacccggtaacccggtaaaaccccctaccgtaaccccctttaacgtttccgaacccgtaccggtacgggggacccgaacggggtaacccgttcggacccgtaccgttaccgaccctacgaccgacccc

SEQ ID NO: 425597 - DNA, 668 bp, Homo sapiens
  misc_feature: GZ8MTXP02GOYQK.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtatgctcattacgtgggctggctccgccacgccccgagggacggcctggagtggattgcgtattgttctttcagtaggtgggagtcgacctactacacgtccctcccctagaacgtagtacgacgtaccacgtgtttccggtacgaccgtaccgtccaacggtcagtactagttcgtctcgtcgacctacgtcgtacgttccgtcgtaccgaccgggtcccgacccggtaaccgacccgggtacccgttaccttacgttaccgtcggttcgaccggtagtaccggtcgaacggtaccgggtaacccgtaaaacccccgtacccgtaaacccccgttacgtttaccggaacccgtacccgggtacggggacccgtaacgggggtaaccccgttcggtaccccgtaccgtacccgaccgtaccgaccgtacccccg

SEQ ID NO: 425598 - DNA, 642 bp, Homo sapiens
  misc_feature: GZ8MTXP02GHACX.25.87.H10.1.454.CMB.2.raw
  modified_base (222)..(222): a, c, t, g, unknown or other
  modified_base (241)..(241): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctnattacgtggggctggctccgccacgccccgagggacggcctggagtggattgcgtattgttctttcagttaggtgggagtcgacctactacacgttcccctcccctacgaagagtcgagtccaccttgtttcggttgacctaccgtccacgcagctagttcgtctcgtgactacgtgacgtctcgtccgaccggcccgaccgaccgaccggtccgtacttaacgttaccgtgtcgacggaggacgtccgaacgggtccgggttaaacccggaaaacccccctaaccgtaaacccccgttaacgtttaccggaaacccgtacccggtacgggggaccccgaaacgggggtaaccccgttcgggtaccctacccggtccaacccgtccgaaccggtacccccg

SEQ ID NO: 425599 - DNA, 655 bp, Homo sapiens
  misc_feature: GZ8MTXP02HLL71.25.87.H10.1.454.CMB.2.raw
  modified_base (191)..(191): a, c, t, g, unknown or other
  modified_base (222)..(222): a, c, t, g, unknown or other
  modified_base (397)..(397): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctcacctgctctgtctctggtnactccatcaccagtaatgctcattacgtggggctggctccgccacgcccccgagggacggctggagtggatgcgtattgtctttcgagttaggtgggagtcgtaccttaactaccgacgtcccctcccctacgaacgcgtcgagtccacctgtttccggtgaccacgtacaacgnacgctagttcgtactcgtgactacgtgaccgtctcgccacggcccgccggaaccgccggtccgttactacgttaccgtgtcggacgtagtacgttcgaacgggtaccgggtaacccggaaaacccccttaccgtaaacccccgttacgtttaccggaaacccgtacccgggttacgggggaccccgtaacgggggtaaacccgttcgggtaacccgtaccccggttacccgaaccccttccgaaacccggttcccccg

SEQ ID NO: 425600 - DNA, 647 bp, Homo sapiens
  misc_feature: GZ8MTXP02IXV3Q.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtaatgctcattacgtggggctggctccgccacgcccccgagggaacggcctggagtggattggcgtattgttctttcagtaggtgggagtgcctactacacgtcccctccccctcaagacgtcgagtccacctagtttccggtagaccaccgtcccacgcagctagtttcgtctctgacactgacgttctcgtcgaccggcccgacccgtacgaccgggtcccgtacttacgtttaccgtggtcgacggagtcggttaccgagggtacccggggtaaccggtaaaaccccccttaccgtaaacccccgtttacgtttaccggaacccgtacccggtacgggggaccccgtaaaggggggaaccccgttcgggttacccacccggtaccctacccgtccgtaacccgtcccccg

SEQ ID NO: 425601 - DNA, 637 bp, Homo sapiens
  misc_feature: GZ8MTXP02IGXUE.25.87.H10.1.454.CMB.2.raw
  modified_base (222)..(222): a, c, t, g, unknown or other
  modified_base (240)..(240): a, c, t, g, unknown or other
  modified_base (247)..(247): a, c, t, g, unknown or other
  modified_base (341)..(341): a, c, t, g, unknown or other
  modified_base (346)..(346): a, c, t, g, unknown or other
  modified_base (439)..(439): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattacgnggggctggctccgccacgccccgagggacggcctggagtgattgcgtattgtctttcagtaggtgggagtgcctactacacgtccctcccctanaacgngtcgagtccaacctgtttcggttacacctaccgtccacgcaggctagttcgtctctgacacgtcgacgttctgccacggtcccgaccggtacnccggtacctcttaattccgtgtcgacgtaaggtcgtaccacgggtaccggtaaacccggtaaaaccccctaccgttaaaccccgttacgtttaccggaacccgtacccgggtaccgggggacccgtaaaccgggggtaaaccgttccggggtaaccctaccccgggttacctaccccgttacgacccggtaacccccg

SEQ ID NO: 425602 - DNA, 574 bp, Homo sapiens
  misc_feature: GZ8MTXP02G9TG8.25.87.H10.1.454.CMB.2.raw
  modified_base (223)..(223): a, c, t, g, unknown or other
  modified_base (248)..(248): a, c, t, g, unknown or other
  modified_base (306)..(306): a, c, t, g, unknown or other
  modified_base (565)..(565): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnactcatcacagtatgctcattacgnggggctggcctccgccacgcccccgagggacggcctggagtggatgcgtattgtcttnagtgtgggatcgacctactacacgtcccctcccctacgaagtacgtcgaacgtccaaccttagtttcggtagacctaccgtccaacgcaacgcctaggtttctctcgtgaacctactgacctcgtcgaccgaccggcccgccgtaacgcccggtcgtacttagtactggtagacgagcgtcgaggtccggacgaaaacccctacaaacccgttactcgacctacggtacggccgaaggaaccgtgacctacgcctaccnccacgcccc

SEQ ID NO: 425603 - DNA, 703 bp, Homo sapiens
  misc_feature: GZ8MTXP02JL5IQ.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtaatgctcattacgtgggctggctccgccacgcccccgagggacggcctggagtggattggcgtattcgttctttcagttaggtgggagtcgtccctaactacacgtcccctccccctacgaacgtacgtcgagtccacccgtagtttttcgggttcgaaccgtaccgtacccgaacgtccaaacgtccgtaaggttttcggttccttcgtcggaaccttacgtcgggtaaccgtttctcggttacccgacccggggtcccgaccccggaacggtaacccgggtcccgttacttaacgtttaccgcggttcggacggagtacggtcgtacgggtccgggttaacccgggaaaacccccttaccggtaaaccccctttacgtttacgaacccgtaccggtcgggggaccctaaacgggggaaccccgttggttaccccacccggtcctaacccgttccgacggtaccccc

SEQ ID NO: 425604 - DNA, 541 bp, Homo sapiens
  misc_feature: GZ8MTXP02FWNB7.25.87.H10.1.454.CMB.2.raw
  modified_base (222)..(222): a, c, t, g, unknown or other
  modified_base (309)..(309): a, c, t, g, unknown or other
  modified_base (362)..(362): a, c, t, g, unknown or other
  modified_base (448)..(448): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgcccccagggaacggcctggagtggattggcgattgtctttnataggtgggagtgcctactacacgtccctcccctacaagagtcgagtcacctntttcggtagactaccgtccaacgcagctagttcgtctctagacactgacgtctgaccacggccgccgtacacggctactagttacngtgacgtagagtcagcggtacgaaaacccctacaaacccctgttcgacaccgtcgggaccaagggaaccgtggaccacgtcaccgtcacgccc

SEQ ID NO: 425605 - DNA, 648 bp, Homo sapiens
  misc_feature: GZ8MTXP02I35QS.25.87.H10.1.454.CMB.2.raw
  modified_base (223)..(223): a, c, t, g, unknown or other
  modified_base (240)..(240): a, c, t, g, unknown or other
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgacgcccagggcaggtgaagccttcggagaccctgtccctcacctgctctgtctctggtnactccatcacctagtangctcattacgngggctcggctccgccacgccccgagggacggcctggagtggtatgcgtattcgtctttcagtggtgggagtcgacccttactacgaccgttccccctaccccgtacgaacgtacgtccgtaacgttaccctaacccgttaggtttttccgggtacgaacccgtaccgtcccaacggcgagtaccgtagtttcgtctacgtcgactacgtcggtacgttctgaccgaccggcccgaccgtacgcccggtcttacttagtcgtcgtgacggtagtacgtcgacggtaccgtaacccggtaaacccctacctaaccccttacttacgaccgtaccggtacggggacccgtaaacggggaaccgttcggacctaccggcctacccgtacgaccgtaccccg

SEQ ID NO: 425606 - DNA, 633 bp, Homo sapiens
  misc_feature: GZ8MTXP02JOBK7.25.87.H10.1.454.CMB.2.raw
  modified_base (222)..(222): a, c, t, g, unknown or other
  modified_base (246)..(246): a, c, t, g, unknown or other
  modified_base (299)..(299): a, c, t, g, unknown or other
  modified_base (336)..(336): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattcgngggctggctccgccacgccccgaggacggctggagtggattgcgtatgtcttnagtgtgggagtgcctactacaccgttccctcccctanaagtacgtcgtacgtacaccgttgtttcgggttcacctaccgtccacgcaggctaggttctctcgtcgactacgtcgacgttcgcgtaccgaccggcccggcccgtacgacccgggtccgttcttaacgttaccgtggtcgacggttaacgcgtacggaacggtaccgggtaacccggtaaaacccccttacctaaaccccgtttacgttacggaacccgtaccggttaccgggggacctaaacgggggtaacccgtcgggttaccccaaccgtccaacccgtcgaccgtacccccg

SEQ ID NO: 425607 - DNA, 602 bp, Homo sapiens
  misc_feature: GZ8MTXP02F22YI.25.87.H10.1.454.CMB.2.raw
  modified_base (222)..(222): a, c, t, g, unknown or other
  modified_base (240)..(240): a, c, t, g, unknown or other
  modified_base (247)..(247): a, c, t, g, unknown or other
  modified_base (341)..(341): a, c, t, g, unknown or other
  modified_base (345)..(345): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctnattacgnggggctggctccgccacgccccgagggacggctggagtggattgcgtattgtctttcagtaggtgggagtgcctactacacgtccctcccctanaagngtcgagtccactgtttcgtgactaccgtccacgcagctagtttgtctcgtagactacgtcgacgttcttgccgaccgggcccgaccgacgtacccgggtccgttacttagttacctgtcgacgagtacgtcgacggccggtaaccgaaaacccctaccgtaaaccccttacgtttaccgaaccgtaccggtacgggggaccctaacgggggtaacccgtcggttacccacccggtcacccgtcgaccggtacccccg

SEQ ID NO: 425608 - DNA, 617 bp, Homo sapiens
  misc_feature: GZ8MTXP02JJUKE.25.87.H10.1.454.CMB.2.raw
  modified_base (308)..(308): a, c, t, g, unknown or other
  modified_base (342)..(342): a, c, t, g, unknown or other
  modified_base (345)..(345): a, c, t, g, unknown or other
  modified_base (362)..(362): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtatgcaggagtcgagcccagggcaggtgaagccttcggagaccctgtcccctcacctgctctgtctctggtgactccatcaccagtaatgctcattactggggctggcctccgccacgcccccgagggacggcctggagtggatgcgtattgtcttnagtggtgggagtgcctactacacgtccctccccnagntcgatcactgtttcgtnacaccgtcacgcagctagttgtcctctgacctactcgaccgttcgtcgccgaccggcccgcccgaccgaccgggtcccgtacttattaccgtcgtcggaccggtagacggttcgacgggtaccgggtaacccggaaaacccccttaccgtaaaccccctttaacgtttaccggaaccgtacccgggtaccggggacccgtaacggggtaacccggtcgggtacccgaccggtcccacccgtacgaccgtcccccg

SEQ ID NO: 425609 - DNA, 720 bp, Homo sapiens
  misc_feature: GZ8MTXP02HBUA1.25.87.H10.1.454.CMB.2.raw
  modified_base (222)..(222): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggcctccgccgacgcccccgaggggaacggcctgggagtggattggcgtattgtctttcgataggtgggagtcgccgtaactaccgacggtcccctccccctacgaagcgttacgagtccactacgtttccgggttagacctacccgtccaacgcgaacgccgtagttcgtctacgtcgaaacctcgtacgaccgttcgtacgtacccgaccgggaccccgcccggaaccgacccggggtccttacgttacgtttaacccgtggtacgaccggtaagtaacggtccgaaacggggtacccggttaaacccggaaaaccccccttaaacccgttaaaccccctttacgtttacccgggaaaccctacccgggtaccgggggaccccgtaaaacgggggtaacccccgttcggggttaaaccccaccccggttacccacccgttaccccgaaacggtacccccccg

SEQ ID NO: 425610 - DNA, 695 bp, Homo sapiens
  misc_feature: GZ8MTXP02HTJY1.25.87.H10.1.454.CMB.2.raw
  modified_base (212)..(212): a, c, t, g, unknown or other
  modified_base (223)..(223): a, c, t, g, unknown or other
  modified_base (245)..(245): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctntgtctctggtnactccatccaacagtaatgctnattacgtgggctggcctccgccacgcccccgagggacggccgtggagtggattggcgtagtttcgtctttacgagttaggtgggtacgtcggacccttactaacccgtaccgttccccctacccctacgaacgtacgtacgtacgtacctacgttacggttttccggttagacctaccggttacccaacggaccaagcccgttaaggtttcggtcctttctacggaccctacgtacggtaccgtcttcgggacccgacccgggcccgccggttaaccgccgggtaccttcctaagtttcccggtgtcgacgtaggcgtaccggacgggtaccggtaacccgtaaaccccttaacccgtaacccgttaccgttaccgacccgtaccgggacgggaccggaaccgggtaaccgtacggtacccgtaccgtaccacccgtccgtacccacccg

SEQ ID NO: 425611 - DNA, 786 bp, Homo sapiens
  misc_feature: GZ8MTXP02H0KF8.25.87.H10.1.454.CMB.2.raw
  modified_base (194)..(194): a, c, t, g, unknown or other
  modified_base (225)..(225): a, c, t, g, unknown or other
  modified_base (295)..(295): a, c, t, g, unknown or other
tcagactgtacagtcacgaccggtgctcgatttagcagtactgcgttgggtttgggctcaactctcttgacctcctgtgcaagaacatgaagcacctgtggtttcttcctcctgctggtggcggcgcccagatgggtcctgtcccagctgcgtctgcaggagtcgagcccgagggcaggtgaagccttcggganaccctgtccctcacctgctctgtctctggtnactcatcacagtatgctcattacgtggggctcggcctccgccgacgacccccgaggggacggccgtaggnggtaggtacttcggcgttagtttcgttacctttcgtaaggttaggtaggggtagttcggtacccttaacgtaccgtaacccgttccccctaccccctacgaaaggtacgtaccggtaactacccgtaaccctttaggtttttcccgggttacgaaccctaccgggttacccaacggtcaacggtacctaggtttccgtcctaacggtaggaacccttaacgttccggtacgtttccgaacgttacccgaccggggacccccggttccggaacccgtaacggggttcccccttatttaacggtttccggtacggtacggacggtacgtacggtaccgggaacgggtaccccgggtaaaaccccgtaaaacccccttaaaccgttaaccccgtttacgtaccggacccggtaccgggacggggtacccggtaaaccgggggtaacccggtaccggtacccgtacccgtacccacccgtcccgtacccgacccg

SEQ ID NO: 425612 - DNA, 588 bp, Homo sapiens
  misc_feature: GZ8MTXP02HMV1Q.25.87.H10.1.454.CMB.2.raw
  modified_base (223)..(223): a, c, t, g, unknown or other
  modified_base (248)..(248): a, c, t, g, unknown or other
  modified_base (315)..(315): a, c, t, g, unknown or other
  modified_base (343)..(343): a, c, t, g, unknown or other
  modified_base (403)..(403): a, c, t, g, unknown or other
  modified_base (417)..(417): a, c, t, g, unknown or other
  modified_base (471)..(471): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctcgtggtnactcatcacagtatgctctatacgnggggctcggcctccgccaccgacccccgagggacggccgtggagtggattcgcgtattcgtctttanaagttaggtgggatcgacctaactaccncgtcccctccctacgaagcgtcgagtaccacttgtttcggtagaccacgtccacgcacgntacgttctctacgngactacgtgactcgtcgccgacggccgaccgacgaccggtctatagtacgtggngcgagacgtcaggaccgtaaccgtaaaacccctacgtaaacccctagttacgaacctaccggtcgggaccgaacgggtaaccgttcgacccgtacgccaaccgtaccacgtcccccg

SEQ ID NO: 425613 - DNA, 593 bp, Homo sapiens
  misc_feature: GZ8MTXP02J3EF1.25.87.H10.1.454.CMB.2.raw
  modified_base (202)..(202): a, c, t, g, unknown or other
  modified_base (222)..(222): a, c, t, g, unknown or other
  modified_base (344)..(344): a, c, t, g, unknown or other
  modified_base (460)..(460): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtcccncacctgctctgtctctggtnactcatcacagtaatgctacatacgtggggctggcctccgccacgccccgagggacggcctggagtggattggctattgtcttcgagtggtgggagtcgcctactacacgtcccctccctanagcgtcgagtccactgtttcggtacacacgtccaacgctacgactagttgtctctagcctacgtcgtacgtctacgtccaccgggccgccgtaccgacgggtcctactattaccgngtcgacgagtcgtcgacggtaccggtaaccgtaaaccccctaaccgtaacccttacgttacgaccgtaccggtacggggaacctacgggggtaaccgtcggtaccacccgtaccacccgtacgacccgtcccg

SEQ ID NO: 425614 - DNA, 559 bp, Homo sapiens
  misc_feature: GZ8MTXP02IE4J1.25.87.H10.1.454.CMB.2.raw
  modified_base (222)..(222): a, c, t, g, unknown or other
  modified_base (451)..(451): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgtggggctggcctccgccacgcccccgagggacggcctggagtggatgcgtattgtctttcagtaggtgggagtgcctactacacgtcccctcccctacaagagtcgagtcacctgtttcggttgaccacgtccacgacagcctagtcgtctctgacactgacgtctcgtccacggcccgccgacacgggtcctactattacgtgngcgagtagtcaggtccggtacggaaaacccctacaaccccttattacgacctaccggtcgggggacccaagggggaacccgtggtaccaccgtccaccgtcacgtccc

SEQ ID NO: 425615 - DNA, 639 bp, Homo sapiens
  misc_feature: GZ8MTXP02ISJ92.25.87.H10.1.454.CMB.2.raw
  modified_base (222)..(222): a, c, t, g, unknown or other
  modified_base (239)..(239): a, c, t, g, unknown or other
  modified_base (486)..(486): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaangctcattacgtggggctggctccgccacgcccccgagggacggctggagtggattgcgtattgttctttcagtaggtgggtagtgacccgtactaccacgtccccctcccctacgaagtacgtcgacgtaccacctgttttccggtcgaccaccgtccagcagctagttcgtctctgaaccagttcgacgttcgtacgccgaccgggcccgtacccgaccgaccgggtcccttacttagttacccgnggtcgacgagtacgtcgaacgggtccggtaccgaaaacccccttacaaaccccctttgtttaccggaaccgtaccccggtacgggggaccccgtaaacgggggtaaccgttcgggacctacccggtacctaccccgtacgtaaccgtcccccg

SEQ ID NO: 425616 - DNA, 647 bp, Homo sapiens
  misc_feature: GZ8MTXP02GDPM1.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccgttcggacgaccctgtccctcacctgctctgtctcgtggtgactccatcaccagtatgctcattacgtggggctcggcctccgccacgcccccggagggacggccgtggagtggtagtgcgtattgtctttcagtaggtgggagtcgtacctacgtacctacgtcccctcccctacgaacgacgtacgacgtcctaccgtagtttcgtcgacaccgtccacgcagtcagtttcgtctctacgactactcgtaccgttctcgccgtaccggcccgacccggaaccgcccggttccgtacttacgtttacgcggttcggagacgtacgtccggtacggtacccggggtaacccgaaaacccccttacccgtaaaccccgtttacgtttaccgaaaccgttcccggaccggggaccgaacgggtaacccggtcggtaccacccgtccaccgtacgcgtaacccccg

SEQ ID NO: 425617 - DNA, 649 bp, Homo sapiens
  misc_feature: GZ8MTXP02JHF9B.25.87.H10.1.454.CMB.2.raw
  modified_base (379)..(379): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtatgctcatacgtgggctggctccgccacgcccccgagggacggccgtggacgtggatggcgtattgtctttcagttaggtgggagtcgacctactacgacgtcccctcccctacgaacgcgtacgagtccactcgtttcggtanacctaccgtccacgcagctagttcgtctcgtacgacctacgtcgaccgttctcggtccgaccgggccccgaccggaaccgacccgggtcccgttacttaacgtttacgtcggtcgacggtacggacgttaccgacgggtaccgggtaacccggtaaaaccccctaccgtaaaccccctttacgttaccggaacccgtaccggtaccgggggacccgaaccgggggtaacccgtcggtacccacccggttacacccgtcgacctacccccg

SEQ ID NO: 425618 - DNA, 734 bp, Homo sapiens
  misc_feature: GZ8MTXP02HGJ3J.25.87.H10.1.454.CMB.2.raw
  modified_base (222)..(222): a, c, t, g, unknown or other
  modified_base (241)..(241): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattacgtgggctggctccgccacggcccccgagggacggcgtggagtggattgcgtattcgtctttcagttaggtgggtacgtcgacccttactacctaccgttcccctacccccgtacgaaacgtcgtacgagtaccctacttacggttttccggttacgaacctacccgtaccacggcctaacgcttaggtttcgttctccgttacggaacctacgttcggtaccgttctacggtcccgaacccgggtccccggaccccggaaaccgtcccgggttacccgtactttaccgtttacgtcggttacggacggacggtacgtaccgtaacggggtacccggtaaaccccgttaaaaccccccgtaccccgtaaacccccgtttacggtttaccggaaccccgttacccgggtacggggggaccccctaacgggggtaaccccgttacgggaccccgtacccgttacccgaacccgttccgacccgtacccccg

SEQ ID NO: 425619 - DNA, 641 bp, Homo sapiens
  misc_feature: GZ8MTXP02HWHHR.25.87.H10.1.454.CMB.2.raw
  modified_base (222)..(222): a, c, t, g, unknown or other
  modified_base (251)..(251): a, c, t, g, unknown or other
  modified_base (310)..(310): a, c, t, g, unknown or other
  modified_base (376)..(376): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctctattacgnggggctggcctccgccacgcccccgagggacggcctggagtggattgcgtattgtcttnagtggtgggagtcgacctactacgacgtcccctcccctacaagcgtcgagtccactagtttcggtnaccaccgtccacgcagctagttcgtctctgaccagtcgtacgtcttgcccgaccggcccgaccgacgtaccggtccgttactaacttacgtcggtgaccgtaaaggcgttacgaacgggtccgggtaaaccggtaaaacccccctacgtaaaccccccgtttatttaccggaaacccgtacccgggttacgggggaacccgaacgggggtaaacccgttcggtacccgtacccggtaccaccccggtacgtacccgtacccccgg

SEQ ID NO: 425620 - DNA, 606 bp, Homo sapiens
  misc_feature: GZ8MTXP02INRUJ.25.87.H10.1.454.CMB.2.raw
  modified_base (222)..(222): a, c, t, g, unknown or other
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgngggctgctccgccacgcccccgaggaggcctggagtggatgcgtattgtctttcagtaggtgggagtgctactacacgtcccctcccctacaagcgtcgagtaccactgtttcgtagacaccgtccacgcagctagttcgtctcgtagactactgaccgtctacgtccgaccggacccgcccggaccgaccgggtcctacttaacgttacgtgtacggacgtaagcgtacgacggtccgtaacccggtaaaaccccctaccgtaaacccctttacgttacgaccgtacccggtcggggacccaacgggggaacccgtcggtacccgacccggttaccacccgttacgaccgacccccg

SEQ ID NO: 425621 - DNA, 621 bp, Homo sapiens
  misc_feature: GZ8MTXP02GLWIC.25.87.H10.1.454.CMB.2.raw
  modified_base (222)..(222): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctcattacgtggggctggctccgccacgcccccgagggacggcctggagtggattggcgtattgtctttcgagttaggtgggagtcgtacctactacgacgttcccctcccctacgaagagtcgagtccactgtttcggtgacctacgtccacgcagcagttcgtctctgaccactcgacgtctcgtccaccgggcccgtccgaccgtaccggtcccgttcttaacgttaccgtcgtcgaccgtaaggtcgttaccgacggtaccggggtaaccggaaaacccccttacccgtaaccccgttactttacggacctaccgggtcgggacccgtaacggggaacccgttacgccgtaaccggtccacccgtacgaccgtacccg

SEQ ID NO: 425622 - DNA, 620 bp, Homo sapiens
  misc_feature: GZ8MTXP02HFDOV.25.87.H10.1.454.CMB.2.raw
  modified_base (222)..(222): a, c, t, g, unknown or other
  modified_base (240)..(240): a, c, t, g, unknown or other
  modified_base (246)..(246): a, c, t, g, unknown or other
  modified_base (297)..(297): a, c, t, g, unknown or other
  modified_base (314)..(314): a, c, t, g, unknown or other
  modified_base (351)..(351): a, c, t, g, unknown or other
  modified_base (356)..(356): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagctttcggagaccctgtccctcacctgctctgtctctggtnactcatcacagtatgctnattcgngggctgctcgcacgccccgaggacggctggagtggatgcgtattcgtcttnagtggtgggatgcctanctacgtccctccctacagtcgtcgatcactgttcgtnaaccncgtccagcacgctagttctctctagacacttggacttcgtacgtccgaccggcccgacccggaaccgccggtccgttacttacgttacgtcgtacggacggtacgacggttaccgagggtacccgggtaaccgtaaaacccccgttaccgtaaacccccgtttagtttaacccggaacgtacccggtacgggggtacccgaaacgggggtaacccgtcggggtaccccttacccgggaccctacccgtaccggtacctcccccg

SEQ ID NO: 425623 - DNA, 629 bp, Homo sapiens
  misc_feature: GZ8MTXP02F4H89.25.87.H10.1.454.CMB.2.raw
  modified_base (251)..(251): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtgactccatcaccagtaatgctcattacgngggctggctccgccacgccccgagggacggctggagtggattggcgtattgtctttcagtaggtgggagtcgcctactacacgtccctcccctagagacgtcgagtacctacctgtttcggtacgactaccgtccacgctagctagttcgtctcgtacgactacgtcgtacgtcgtcgtaccgaccggcccggacccgaccgaccggtccttacgttacgttacgtcgtacgcgaggtacgtcgacgggccggtaaccgtaaaacccctacccgtaacccttacttaccggaaccgtaccgggtacgggggacccgtaacgggggtaacccggtcggtacccgtaacccggtccaacccgttccgacccggtaccccg

SEQ ID NO: 425624 - DNA, 608 bp, Homo sapiens
  misc_feature: GZ8MTXP02GWICA.25.87.H10.1.454.CMB.2.raw
  modified_base (222)..(222): a, c, t, g, unknown or other
  modified_base (236)..(236): a, c, t, g, unknown or other
  modified_base (246)..(246): a, c, t, g, unknown or other
  modified_base (300)..(300): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtangctcatacgngggctggctccgcacgccccgagggacggcctggagtggatgcgtattgtcttnagtaggtgggagtgcctactacacgtccctcccctagaagtacgtcgagtccacgtagtttccggtacaccgtaccgtccgacgcagcctagttcgtctcgtacgactacgtgtacgtcgttcgccgaaccggcccgacccgacgaccgggtccgttacttagttaccctggtacgcgtagtacggtcgacgggtccggtaacccggtaaaacccctaccgtaaaccccttacgttacgaaaccgtccggtacggggaccaacggggtaaccgtcggtacccacggtccacgtaccgacgtacccccg

SEQ ID NO: 425625 - DNA, 556 bp, Homo sapiens
  misc_feature: GZ8MTXP02FKCEL.25.87.H10.1.454.CMB.2.raw
  modified_base (179)..(179): a, c, t, g, unknown or other
  modified_base (191)..(191): a, c, t, g, unknown or other
  modified_base (222)..(222): a, c, t, g, unknown or other
  modified_base (251)..(251): a, c, t, g, unknown or other
  modified_base (261)..(261): a, c, t, g, unknown or other
  modified_base (341)..(341): a, c, t, g, unknown or other
  modified_base (348)..(348): a, c, t, g, unknown or other
  modified_base (370)..(370): a, c, t, g, unknown or other
  modified_base (385)..(385): a, c, t, g, unknown or other
  modified_base (397)..(397): a, c, t, g, unknown or other
  modified_base (427)..(427): a, c, t, g, unknown or other
  modified_base (434)..(434): a, c, t, g, unknown or other
  modified_base (443)..(443): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtnaagccttcgganaccctgtccctcacctgctctgtctctggtnacctccatccaccagtatgctcattacgnggggctggcnccgccacgcccccgagggacgggcctggagtggattgcgtattgttcttcagtaggtgggagtcgcctactcacgtcccnccccctnagatcgacgtcactgttcggtnaccacgtccagccancgagtttgctcngactctgcgtctcgccgccggcccgcgacncgtcctntactcgtgngcgagcgcgacgtccgtaaccgaaacccctactaaccccgtacttacgaccgtaccggtcgggaccgacggggtaaccgtcgacccgtaccgtccaccgtaccgaccgtcccg

SEQ ID NO: 425626 - DNA, 561 bp, Homo sapiens
  misc_feature: GZ8MTXP02F6DVW.25.87.H10.1.454.CMB.2.raw
  modified_base (357)..(357): a, c, t, g, unknown or other
  modified_base (384)..(384): a, c, t, g, unknown or other
  modified_base (407)..(407): a, c, t, g, unknown or other
  modified_base (435)..(435): a, c, t, g, unknown or other
  modified_base (437)..(437): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattacgtggggctggctccgccagcccccgaggaacggcctggagtggattgcgattgtctttcagtagtgggagtgcctacacacgtccctccctcaagagtcgagtcacctntttcggtagacacgtccagcagcagtntctctgacactgacgtctgtacncggccgtcgacacggccgtctaattcgngngacgagactcgacggtacggtaccgtaaaacccctacctaaaccccgttacgttaccgaccgtaccggtacggggaccgaacgggtaaccgtcggtacccgaccgtaccacctccgaccgtccg

SEQ ID NO: 425627 - DNA, 670 bp, Homo sapiens
  misc_feature: GZ8MTXP02FR9P4.25.87.H10.1.454.CMB.2.raw
  modified_base (222)..(222): a, c, t, g, unknown or other
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacgnggggctggcctccgccacgcccccgagggacggccgtggagtggatgcgtattgttctttcagtaggtgggacgtcgtacccttaactacaccgttcccctacccccgtacaagtacgtcgacgtaccaccgtagtttcggtacgacctaccgtccacgcagtctagttcgtctcgtacgactacgtcgtacgttcgtcgtaccaccgggcccgacccggaccgaccgggtccgttacttaacgtttacgtcggtcgacggaggtaacgtccgaacgggtacccgggtaaaccggaaaaccccccttacctaaacccccgtttacgtttaccggaacccgtacccggtacgggggaaccccgtaaacggggtaacccggttcgggtacccacccggttccaacccgtaccgaaccgcccccg

SEQ ID NO: 425628 - DNA, 691 bp, Homo sapiens
  misc_feature: GZ8MTXP02G9EDL.25.87.H10.1.454.CMB.2.raw
  modified_base (226)..(226): a, c, t, g, unknown or other
  modified_base (251)..(251): a, c, t, g, unknown or other
  modified_base (323)..(323): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaacgtccttcggacgaccctgtccctcacctgctctgtctcgtggtnactcatcacatatgctcattacggnggggctcggacctccgccgacgcccccgaggggacggccgtggagtggtattcggcgtagtttcgttcttanaggtaggtgggagtcacctactaccgtacgtcccctacccgtacgaagacgtcgtacgtaccacttcgttttcggtacaaccctacgtaccacgcgtaacgcgtaacggtttctctacgtacgaaccttcgtaccggtacgttcgtcggacccgacggacccccgaccggaaccggtaccccgggttccttaacgtttaacgtttccggtcgtaacggccggtaaggtaccgtacggacgggtaacccggtaaccccggtaaaaccccctacccgttaaacccttacggtaccgaacccggtacggtaccggggaccgtaacgggtaaccgtcggtacccaccgtacacccgtacgaccggaaccccg

SEQ ID NO: 425629 - DNA, 689 bp, Homo sapiens
  misc_feature: GZ8MTXP02JUWMK.25.87.H10.1.454.CMB.2.raw
  modified_base (223)..(223): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctcgtggtnactcatcacagtatcgctacattacgtggggctggcctccgccacgcccccgagggaggcctggagtggatgcgtattgtctttcgagtagtgggtagtgacccttataccacgtcccctacccctacgaaagtcgtaccgaagtccaacccgttagttttccgggtagtaccgtaaccgttcccaacgcctaacgggtcctaggtttttcgccttcgttcgaacccgtaagttcggacgttccttcggtaccgacccggacccgccgaccgaacccgggtccttaccttagttaccgtgtacgaccgtaggaccgttcgaacggcccggtaaaccggtaaaacccccttaccggtaaaccccttaacgtttccgaaccggttaccgccgggggtaaccccgagggggtaaacccgttcgggtacccttaaaccccggtccgtaccctaaccgccggtaacccccg

SEQ ID NO: 425630 - DNA, 667 bp, Homo sapiens
  misc_feature: GZ8MTXP02GMEXB.25.87.H10.1.454.CMB.2.raw
  modified_base (222)..(222): a, c, t, g, unknown or other
  modified_base (292)..(292): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctctatacgtggggctggcctccgccacgccccgagggacggctggagtggatgngtattgtctttacagttaggtgggtagtcgtaccctaactaccgtaccgttccccctacccctacgaaaggacgtcggaacgttcctaaccgtagtttttccggggtacgacccgtacccggttaccccaacggcctaacggtccgtaaggtttcgtccttcgtacggaaccctacgtcgtaccgttcgtcggtacccaccgggcccgacccggacgtacccgggtccgttacctagttaccgtgtcgacgaggtacgtcgaggaccggtaccgaaaaccccctacgtaacccttacgttacgaccgaccggtaccggggacccgtaagggtaacccgtcggtacctacccggtccaccgtccgaacgtcccccg

SEQ ID NO: 425631 - DNA, 565 bp, Homo sapiens
  misc_feature: GZ8MTXP02FZMPM.25.87.H10.1.454.CMB.2.raw
  modified_base (222)..(222): a, c, t, g, unknown or other
  modified_base (321)..(321): a, c, t, g, unknown or other
  modified_base (353)..(353): a, c, t, g, unknown or other
  modified_base (360)..(360): a, c, t, g, unknown or other
  modified_base (391)..(391): a, c, t, g, unknown or other
  modified_base (433)..(433): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattactggggctggctccgccacgccccccagggaaggcctggagtggattgcgattgtcttcatagtgggagtgcctanacacgtccctcccctcaagagtcgagtcactnttcggtnacacgtcacgcagctagttgtctctgacacngacgtctgtaccacggcccgccgacgaccgggctctattacngtgcgagacgtcgaggtccggtacgaaaaccccctactaaacccccttacgtttacgaaaccgtacgggaccggacggaaccggtaaccggtacgtacccggtacctacctacccgacggtccctacccccg

SEQ ID NO: 425632 - DNA, 697 bp, Homo sapiens
  misc_feature: GZ8MTXP02HY22O.25.87.H10.1.454.CMB.2.raw
  modified_base (203)..(203): a, c, t, g, unknown or other
  modified_base (222)..(222): a, c, t, g, unknown or other
  modified_base (236)..(236): a, c, t, g, unknown or other
  modified_base (356)..(356): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctnacctgctctgtctctggtnactcatcacagtangctcattacgtggggctggcctaccgccagcccccgagggaacggcctggagtggacttggcgtattggtctttcagtaggtgggagtcgaccctagtacctacgtacccctccccctanaaacggtagtcggtacgttaccaacccttgtttaccgggtttacggaaccaccgttacccaaccggtcacggcctagttcgttctacgtacgtactaaccgttggacgttcctcggttcccaaccggggtccccggacccgaaccgtacgggggccccgtttataacgttaccgtggttcgaccggttagaagggtccgaacgtaccgggggttaaccgaaaaacccccttaaccgtaaacccccgtttacgttacgaaaccttacccgggcgggggtaacccaacgggggtaaacccgtcggggtaaccacccggtacgaaccctcggaaacgtcccccg

SEQ ID NO: 425633 - DNA, 590 bp, Homo sapiens
  misc_feature: GZ8MTXP02HHIL9.25.87.H10.1.454.CMB.2.raw
  modified_base (222)..(222): a, c, t, g, unknown or other
  modified_base (247)..(247): a, c, t, g, unknown or other
  modified_base (365)..(365): a, c, t, g, unknown or other
  modified_base (390)..(390): a, c, t, g, unknown or other
  modified_base (395)..(395): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgngggctggctccgcacgccccgaggacggcctggagtgattgcgtattgtctttcagtagtgggagtgcctactacacgtccctcccctacgaagcgtcgagtccacgtgtttcggtanacacgtccacgcagctagttgtctntgacncgtgacgtctgtcgacggccgcgtaaccgcggtccgttatacgttcgtgtcgacgagtacgtcgaggtaccggtaccggtaaaaccccctacgtaacccccgttagtttaccggaccgtaaccgggttcggggacccgttacgggggaacccgttggtacccaccggttaccacccgttacgaaccggtcccccg

SEQ ID NO: 425634 - DNA, 606 bp, Homo sapiens
  misc_feature: GZ8MTXP02IE77Q.25.87.H10.1.454.CMB.2.raw
  modified_base (217)..(217): a, c, t, g, unknown or other
  modified_base (222)..(222): a, c, t, g, unknown or other
  modified_base (249)..(249): a, c, t, g, unknown or other
  modified_base (308)..(308): a, c, t, g, unknown or other
  modified_base (376)..(376): a, c, t, g, unknown or other
  modified_base (463)..(463): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctntggtnactcatcaccagtatgctcagttacgnggggctggctccgccacgcccccgagggacggcctggagtggatgcgtattcgtctttnagttacggtgggagtcgacctactacgacgtccctccccacgaagcgtcgagtaccactgtttcggtnaacctcgtccacgcagctgtcgtctctgactacgtgtacgtctcgtaccgccggccgcccgacgccgggtccttacgttacttacgngtacggcgagtacgtcgaaggtccgggtaaccgtaaacccctacctaaaccccttacgtttaccgaaccgttaccggacgggggtaccaacgggggtaacccgttcggtacccgacccgttccgacccttcgaacgtcccccg

SEQ ID NO: 425635 - DNA, 605 bp, Homo sapiens
  misc_feature: GZ8MTXP02JUVW6.25.87.H10.1.454.CMB.2.raw
  modified_base (282)..(282): a, c, t, g, unknown or other
  modified_base (298)..(298): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagctttcggagaccctgtccctcacctgctctgtctctggtgactccatcacagtaatgctcattactggggctggctccgccagccccaggaggcctgagnggatgcgatgctttanatagtggagtgctactacacgtccctcccctacaacgacgtacgacgtacaacgtagtttccggtagaccgtaccgtaccgaacgctagtacctagttacgtctctagactactcgaacgtctcgtacgaccggtacccgccgaacgaccggccgtacttaacgttacgtgtacggacgacgtacgtacgacgacggtaacggtaaacccgtaacccgtaaacccgtaaccgttacgtaccgtaccgtacggtaccgaacggtaaccggtacggtaccgtaccgtaccgtaccgtaccgacgacccg

SEQ ID NO: 425636 - DNA, 583 bp, Homo sapiens
  misc_feature: GZ8MTXP02GCXPK.25.87.H10.1.454.CMB.2.raw
  modified_base (222)..(222): a, c, t, g, unknown or other
  modified_base (236)..(236): a, c, t, g, unknown or other
  modified_base (448)..(448): a, c, t, g, unknown or other
  modified_base (479)..(479): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtangctcattcgtgggctggctccgccacgcccccgagggacggcctggagtgtattgcgtattgtctttcgagttaggtgggattcgtacccgttaactaccgaccgtttcccctaccccctagaacgtacgttccgtaacgttcccacgttagtttcgggttacaaccgtaccgtcccaagccagctagtttcgctctagactactgaccgtntcgacgacgccgacgacgacgtcgtctatcngtcacgagtacgcgacgcgtaacgtaaaccctcaaccccgttcgtacgaccgtaccgcgggaccgacgggtaacccgtggtcccaccgtcaccgcacgtacccc

SEQ ID NO: 425637 - DNA, 633 bp, Homo sapiens
  misc_feature: GZ8MTXP02J08FO.25.87.H10.1.454.CMB.2.raw
  modified_base (226)..(226): a, c, t, g, unknown or other
  modified_base (290)..(290): a, c, t, g, unknown or other
  modified_base (295)..(295): a, c, t, g, unknown or other
  modified_base (301)..(301): a, c, t, g, unknown or other
  modified_base (491)..(491): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaacgccgttcggacgaccctgtccctcacctgctctgtctctggtnactccatccactagtaatgctctattcgtgggctggcctccgccacgcccgagggacgcgtggngtggntgcgtnttgtcttacgagtaggtgggtacgtcgacctaacgtcgaccgttcccctccctagacgtcgtacgactcctacgttcgttcggtacaccgtaccgtaccgacgctacgtacgttacggttctcctgtacgactacggtcgtacgtctacggccgaccggcccgaccgtacgcggtccctagtactttcgngtacggacgtaggtcgcgtaacgggcccggtaaaaccctaaccccgtaacgtaccccttacggtacgaaccggtccgggtacggggaccgaaacggggttccgtacgtcccgtaaccggttcccacgtaccgactacccccg

SEQ ID NO: 425638 - DNA, 590 bp, Homo sapiens
  misc_feature: GZ8MTXP02HISPL.25.87.H10.1.454.CMB.2.raw
  modified_base (222)..(222): a, c, t, g, unknown or other
  modified_base (236)..(236): a, c, t, g, unknown or other
  modified_base (240)..(240): a, c, t, g, unknown or other
  modified_base (244)..(244): a, c, t, g, unknown or other
  modified_base (295)..(295): a, c, t, g, unknown or other
  modified_base (358)..(358): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtangctnatgngggctgctccgcacgccccgaggacggctggagtggatgcgtattgtcttnagtggtgggatgcctacgtacacgtccctcccctacaagagtcgagtcaccttgtttcggtanacctacgtaccacgcagctagttcgtctcgtagactacgtcgacgtcgtcgtccgaccggcccgccgaaccgtccgggtcccgttactacgttaccgtggtcgacgagtacgtacgacggaccggtaaccgaaaccccctacctaaccccgttacgtttacgaccgtaccggtacgggccgaacgggtaaccgtcggtacccgtaccggtaccaccgtccgaccgtaccccg

SEQ ID NO: 425639 - DNA, 852 bp, Homo sapiens
  misc_feature: GZ8MTXP02F4ZCU.25.87.H10.1.454.CMB.2.raw
  modified_base (244)..(244): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagcccttcggagaccctgtccctcacctgctctgtctctggtgactccatcaccagtaatgctnattacgtggggctggctccgccgacgcccccgagggacggcctggagtggatgcgtattgttctttcagtaggtgggtagtcggtacccttaactacgtaccgttccccttaccccccgtagaaacgtacggtaccgtacgttaccaacccgttagttttaccgggttacgaaaccgtaacccgttcccgaaacggtcccgaaggtacccttaaggtttcggttcccttacgtacggtaacccgtaccgtacgggtaaccgtttcccgttacggtaccccggaccccgggggtaccccggtaccccggaaaccggttacccccggggtcccggtttacctttaaaacgtttacccgtgggttaccggaccgggtaacgggtaccggttaaccggaaaccggggtacccggggttaaaaccccggggtaaaaaaacccccccctttaaacccgtaaaaccccccttttaacccgggttttaaccggaaccccgtaacccggggtttacccggggggaaccccgtaaaaccggggggtaaacccgtccggggtttacccaaaccccggtttacccgaaaccccgttcccgaaacccggttaaccccccgg

SEQ ID NO: 425640 - DNA, 613 bp, Homo sapiens
  misc_feature: GZ8MTXP02IZ09H.25.87.H10.1.454.CMB.2.raw
  modified_base (222)..(222): a, c, t, g, unknown or other
  modified_base (249)..(249): a, c, t, g, unknown or other
  modified_base (513)..(513): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacnggggctggctcgccagcccccagggaacggcctggagtggattgcgtattgtctttcatagtgggagtgcctaactacacgtccctcccctcaagacgtcgagtccactgtttcgttcgaccgaccgttccacggtcagcctagtttctacgtctgactacgtgtacgtcgtgtccacgggcccgcccgacgacggtcccgtcttacttaccgtggttcgcggtagaacggtcgaaggtccgggtaacggaaaaccccccttanaaaccccccgttactttacggacccgtaccgtacgggggcccaaagggggtaacccgttcgggtacccgaaccggttccgaccctcggaaccgtcccccg

SEQ ID NO: 425641 - DNA, 677 bp, Homo sapiens
  misc_feature: GZ8MTXP02GN3UZ.25.87.H10.1.454.CMB.2.raw
  modified_base (191)..(191): a, c, t, g, unknown or other
  modified_base (222)..(222): a, c, t, g, unknown or other
  modified_base (513)..(513): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcgganaccctgtccctcacctgctctgtctctggtnactccatcacagtaatgctcattacgtgggctggctccgccacgccccgagggacggccgtaggagtggattgcgtatttgtctttacgagttaggtgggagtcgtcccttaacgtacctaccgtcccctaccgtaccgaacggtcgtcgacgtacctaccgttagtttccggttacgacgtaccgtaccgaccgtcgaagtcgtaagtttctccgtactggaaacctgtcgtaccgtctcgtaccgaccggtcccgaccggaccgtaccgggtcccttattaacgttcgnggtcggagaacggtcgcgtaaggtacccgggtaaaccgaaacccccttaaccgtaaccccgtttagttacccgaaccgtcccgggttacggggaccgtaacggggtaccccgttaaggcccgtaaccgtaccctaccgtaccgaccgtacccctaaaccccggg

SEQ ID NO: 425642 - DNA, 616 bp, Homo sapiens
  misc_feature: GZ8MTXP02HZE41.25.87.H10.1.454.CMB.2.raw
  modified_base (222)..(222): a, c, t, g, unknown or other
  modified_base (380)..(380): a, c, t, g, unknown or other
  modified_base (435)..(435): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacgtgggctggctccgccacgccccgaggacggcctggagtggattggcgtattcgtctttcagttaggtgggagtcgacctactacctacgtcccctacccctagaagtcgtcgacgtcacctgttttcgggtanacctaccgtccgacgcacgtcgtaggttctctcgtacgacctacgtcgacgttcncggtaccaccgggccgacccgaacgtaccgggtcccttacttacgttcgtggcgtaccgagtacgtcgacggtaccggtaaacccgtaaaaccccctacgtaacccccttacgttacgaacccgtccggtacgggacccgtacgggaaccgttcgaccacccggtcacctcgaccgacccg

SEQ ID NO: 425643 - DNA, 561 bp, Homo sapiens
  misc_feature: GZ8MTXP02FWY6V.25.87.H10.1.454.CMB.2.raw
  modified_base (222)..(222): a, c, t, g, unknown or other
  modified_base (242)..(242): a, c, t, g, unknown or other
  modified_base (305)..(305): a, c, t, g, unknown or other
  modified_base (389)..(389): a, c, t, g, unknown or other
  modified_base (393)..(393): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtatgctnattacgtggggctggctccgccacgcccccgagggacggcctggagtggatgcgattgtcttnagtggtgggatgcctactacgacgtccctcccctcaagagtcgatccacctagtttcgtagacaccgtccaacgcagctagttntctntgaccactgacgtctcgtccgaccggccgccgacgccggtccgtacttacgtactgtgacgagagtcgagccggtacgaaaacccctcaaaccccttcgttacgaccgtaccgtacggggccgtaacgggaaccgttcgtaccgacccgtcgaccctcgaccgacccg

SEQ ID NO: 425644 - DNA, 629 bp, Homo sapiens
  misc_feature: GZ8MTXP02JV0PZ.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtaatgctcattacgtggggctggctccgccacgcccccgagggaacggcctggagtggatgcgtattgtctttcataggtgggagtcgacctactacgacgtcccctcccctacaagagtacgagtccactgtttcggtagacacgtccacgcagctagttcgtctcgtacgaccagtcgtacgtcgtcgtcgaaccggcccgacccgacgaccggtcttacgtagttacgtcgtcggacgtaagacgttccgaacggccgggtaacccggaaaacccccttacccgaaacccccttacgtttaacgaacccgtaccggttaccgggggacccgaacgggggtaacccgtcggggtacccaacccggtccgtaaaccccgcgtaaccgtcccccg

SEQ ID NO: 425645 - DNA, 666 bp, Homo sapiens
  misc_feature: GZ8MTXP02GZ2KT.25.87.H10.1.454.CMB.2.raw
  modified_base (221)..(221): a, c, t, g, unknown or other
  modified_base (397)..(397): a, c, t, g, unknown or other
  modified_base (496)..(496): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctgtnactcatcaccagtaatgctcagttacgtggggctggcctcccgccaccggcccccgaaggggacggccgtaggagtggtattgcgtagttcgttctttcagttaggtgggagtcgtcctaactacgaccgttcccctcccccgtagaaagcgtacgagtccaacgttgtttcgtanaccgtaccgtccacgcagctagtttcgactcgtacaactacgtcgtacgtctacgtccgaccggcccgacccgaacgaccgggtccttattacttacgnggtcgacgagtacgtccgacggtacccgggtaaccgtaaaaccccctacctaaaccccggtttacttaccggaacccgttaccgggtaccggggacccgtaaaccgggggtaacccgtttcgggaacccctacccggtacctaaccccgtaccgacccggttaacccccg

SEQ ID NO: 425646 - DNA, 655 bp, Homo sapiens
  misc_feature: GZ8MTXP02GAFHW.25.87.H10.1.454.CMB.2.raw
  modified_base (222)..(222): a, c, t, g, unknown or other
  modified_base (408)..(408): a, c, t, g, unknown or other
  modified_base (430)..(430): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacgtggggctggctccgccacgcccccgagggacggcctggagtggattgcgtattgtctttcagtagtgggatcgtcctactactacgtcccctacccctacaagagtcgagtaccaactgtttcgggtcactaccgtccaacgcagctagttcgtactcgtnacctacgtgtacgtctcgaccncgggccccgcccgaacgtacccggggtcccttacttaacgtttacgtcggttacggacgtaggtaacgtcccgaaagggtccccggggtaaacccggtaaaaaccccccttaccggtaaaacccccctttacgtttaccggaacccgtacccgggtacgggggaccctaaacgggggaaacccgttcgggtaccacccggttccacccgtaccaacggtcccccg

SEQ ID NO: 425647 - DNA, 650 bp, Homo sapiens
  misc_feature: GZ8MTXP02FTG3N.25.87.H10.1.454.CMB.2.raw
  modified_base (223)..(223): a, c, t, g, unknown or other
  modified_base (242)..(242): a, c, t, g, unknown or other
  modified_base (248)..(248): a, c, t, g, unknown or other
  modified_base (436)..(436): a, c, t, g, unknown or other
  modified_base (499)..(499): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagacccctgtccctcacctgctctgtctctggtnactccatcacagtatgctnattcgngggctggctccgcacgccccgaggacggcctggagtgattgcgtattgtctttcgagttaggtgggtatcgtacctacctactaccgtcccctccccgtacaacggtcgtcgacgtcctaaccgttgtttccgggtacacctaccgtaccgaacgtcgagcgttagtttcgtctacgtagacctaccngtaccgtcttacgccgacccggccccgccggacccgtaccggtccgttacttaagtttaccgnggtcgacgtaaggtcgtcgaacgggaccgggtacccgtaaaaccccctacgttaaacccccttacgtttccgaacccgtaccggtacggggacccgtaacggggtaacccggtcgtacccgtacccgtacaccgttacgaccgtacccccg

SEQ ID NO: 425648 - DNA, 651 bp, Homo sapiens
  misc_feature: GZ8MTXP02H7P1A.25.87.H10.1.454.CMB.2.raw
  modified_base (219)..(219): a, c, t, g, unknown or other
  modified_base (230)..(230): a, c, t, g, unknown or other
  modified_base (244)..(244): a, c, t, g, unknown or other
  modified_base (299)..(299): a, c, t, g, unknown or other
  modified_base (382)..(382): a, c, t, g, unknown or other
  modified_base (642)..(642): a, c, t, g, unknown or other
tcagactgtacagtcacgaccggtgctcgatttagcagtactgcgttgggttggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgagaccctgtccctcacctgcctctgtctctgtnactcatcaccngtaatgctcatacngggctgactccgccacggccccagggacggcctggacggtgattgcgtattcgtnttcagtaggttgggagtgccttactactacgtccctcccctagaacgacgtcgagttccaacccgttagttttccggggttanaaccgtaccgtcccgacggtacacggacctaagttcgtccgtacgttacgaaaccctcgtttacgggaacttccgttcggtccgtaaccgggccccggtacccgaccgtacggggtacccgttattacgttacgtcgtacgaccgtaaggacgttccgaaggccggtaacccggtaaaacccctacggtacccctacttaggacccaacgtcgggaaccgtagggtaaccccgttcggaaccgttcgaaccgcccgttanaccgccccg

SEQ ID NO: 425649 - DNA, 656 bp, Homo sapiens
  misc_feature: GZ8MTXP02GQSUP.25.87.H10.1.454.CMB.2.raw
  modified_base (522)..(522): a, c, t, g, unknown or other
  modified_base (634)..(634): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtcactccatcaccagtatgctacattacgtggggctcggcctccgccacgccccgagggacggcctggagtggattggacgtagtttcgtactttcgagttaggtgggtagtcgtaccctaacgtaccgtaccgtccccttaccccctacgaaggtcgtacgtacgttacctaccgttacgttttcgggtacgtaccgtacccgttacccgacgcacgtcctaggtttccgcttcgtagactacctggtacgttcgtccgtacgaccggcccgaccgaaccgccggtcctattacgtaccgngtacgaggtagtacgctagggaccggtacccgtaaaaccctaccaacccgttcgtacgaccctaccgggtcggggaccctaaacgggggcccttacggtcctaaccccggtnacccgttcgaaccgtacccccg

SEQ ID NO: 425650 - DNA, 630 bp, Homo sapiens
  misc_feature: GZ8MTXP02FMJX5.25.87.H10.1.454.CMB.2.raw
  modified_base (221)..(221): a, c, t, g, unknown or other
  modified_base (245)..(245): a, c, t, g, unknown or other
  modified_base (343)..(343): a, c, t, g, unknown or other
  modified_base (392)..(392): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggnactcatcacagtatgctcattcgnggggctggctccgccacgcccccgagggacggctggagtggattgcgtattgtctttcgagtaggtgggatcgacctacactacgtccctccccctanagacgtcagtccacttgttcgtgaccaccgtccacgcagctagttgctntcgactctcggtactcgtgaccgacgggcccgcccggactacccgggtccgttacttaacttaccgtgtacggacggtaacgacgtacggaaccggtaccggggtaaacccgtaaaacccccctaccgtaaacccccgtttagttacccgaaacccgtaccggttaccgggggaccctaaacgggggtaaacccgtcgggtaacctaccccggtatacccccaccgtaccgacccccg

SEQ ID NO: 425651 - DNA, 627 bp, Homo sapiens
  misc_feature: GZ8MTXP02GE6ZM.25.87.H10.1.454.CMB.2.raw
  modified_base (222)..(222): a, c, t, g, unknown or other
  modified_base (247)..(247): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgnggggctggctccgccacggcccccgagggaacggcctggagtggattgcgtattgtctttcgagtaggtgggagtcgaccttactacacgtcccctcccctacaagagtcgatccactgtttcggtcacaccgtccacgcagctagttcgtctctgactactgacgtctgcacggccgccgacgacggccgtcttacttacgtggtagacgagtagtaccgagggtaccgggtaacccgaaaacccccttaccgtaaaacccccgttcgttttaccgaaccgttaccccgggtacgggggacccgtaaaacgggggtaaccccgttacggggtacccctacccgggtaccccttaacccaccgtaccggtaaaccccccg

SEQ ID NO: 425652 - DNA, 649 bp, Homo sapiens
  misc_feature: GZ8MTXP02JL8K9.25.87.H10.1.454.CMB.2.raw
  modified_base (221)..(221): a, c, t, g, unknown or other
  modified_base (247)..(247): a, c, t, g, unknown or other
  modified_base (396)..(396): a, c, t, g, unknown or other
  modified_base (486)..(486): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgccctcacctgctctgtctctggtnactcatcaccagtaatgctcattcgngggctggctccgcacgcccccgagggaggcctggagtggacttggcgtattcgtcttcagtaggtgggagtgcctactacacgtccctccccgtcaagacgtcgagtcactgtttacggtgacctacgcctacgcagtctagttgctcngacctactcggaccgttctacggtcgaccggaccggtaccgacccgtacgggtcctacgttacgttaccgtggttacggacggtaacggngttaccccgagggtacccgggttaacccggtaaaacccccttaacccgtaaaccccgttaaacgtttaccgaaaccggtacccggttacggggggaaccctaacgggggtaacccgttgggttaaaacccccgccggtacctacccgtaccgaccgtcccccg

SEQ ID NO: 425653 - DNA, 752 bp, Homo sapiens
  misc_feature: GZ8MTXP02IMLYY.25.87.H10.1.454.CMB.2.raw
  modified_base (259)..(259): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagccttcgggagaccctgtccctcacctgcttctgtctcgtggtcactccatcaacctagtaatgctactattacggnggggtctggcctccgccgaccgccccggaaggggaacgggcctgggaggtggtacgttggacgttacgtttgttcctttcaaggttacgggtaggggtagttcggtaccccttaactaccgtaccgttccccctacccctaccgaaaggtcgtaccggtacgttaccacccgttaggttttccgggttacgaaaccgttaccccgtacccgaacgggaccacggtaccgtcggtttcgtcgtacgtacgtaacctacggtcggttaaccgttcttacggcccgaccggcccgacccgaccgtaccgggtccgttacttacgttacgtcggttcgacgaggtaccgtacggtacggcggtaaaaccccgtaaaaccccgtacccgtaaaccccgtttcgtttaaaccggaccgtcccgggtaccgggggaacccgtaacgggggtaaccgttcgggtacccgtaccccgttcgtaaccctcgacccgtaccccg

SEQ ID NO: 425654 - DNA, 676 bp, Homo sapiens
  misc_feature: GZ8MTXP02I8IIT.25.87.H10.1.454.CMB.2.raw
  modified_base (222)..(222): a, c, t, g, unknown or other
  modified_base (309)..(309): a, c, t, g, unknown or other
  modified_base (388)..(388): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctctattacgtggggctggctccgccacgccccgagggacggccgtggagtggattgcgtattgttctttanagtaggtggtagtcgtacctaactaccacgttcccctacccctacaaagacgtcgactccaccgttagtttcgggttanaccgtaccgtccacgaccagtccgttagttcgtctcgtacgtacctacgtcgtaccgttcgttcgaccgacggccccgacccgtacgaccggtaccgttcttacgttaccgtgtacgacggacggtaacgtccgtaacggtacccgggtaaacccgtaaaaccccctaccgtaaaccccgtttacgttacgaaacccgtacccggttacgggggcccgttaaaacggggaaccccggtttacggacccgtaacccgtaccccgtaacccgtaccgtaccgtacccccg

SEQ ID NO: 425655 - DNA, 710 bp, Homo sapiens
  misc_feature: GZ8MTXP02IMAP9.25.87.H10.1.454.CMB.2.raw
  modified_base (224)..(224): a, c, t, g, unknown or other
  modified_base (239)..(239): a, c, t, g, unknown or other
  modified_base (243)..(243): a, c, t, g, unknown or other
  modified_base (250)..(250): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcatgtgaagccttcggacgaccctgtcccctcacctgctctgtctctggtnactccatcacagtangctnattacgngggctcggctccgccacgcccccgagggacggcgtggagtggattggcgtagtttgtctttacgagttagggtgggtagtcgtaccctacgtacgtaccgttcccccctcccgtacgaacggtacgttacgaacgttacctaccgttagtttttaccggtacgacccgtaaccgtcccgaaacgtccgaagtccgtaggtttcgtccttacgtacgtaactacggttacgtacccgttcgttccgaccgacccgggccccggaccgtaacccgtaccggggtccctttacgttacgttaccgtgggtacgacggtagtacggtccgaagggtaccccgggttaaaccggaaaacccccttaaccgtaaacccccgtttagtttaccgaacccgtacccggtacggggacccgtaacggggtaacccgtcggtacccaaccgtcccgtaactccgaacccg

SEQ ID NO: 425656 - DNA, 637 bp, Homo sapiens
  misc_feature: GZ8MTXP02FW5WS.25.87.H10.1.454.CMB.2.raw
  modified_base (155)..(155): a, c, t, g, unknown or other
  modified_base (227)..(227): a, c, t, g, unknown or other
  modified_base (508)..(508): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtccctgtcccagctgcgtcngcaggagtcgagcccagggcaggtgaaagcccttcggacgaccctgtcccctcacctgctctgtctctggtnacctccatcaccagtaatgctcattacgtggggctcggcctccgccacgcccccgagggaacggccgtggagtggattgcgtagttgtcctttacagtaggtgggagtcgacctaactactaccgtcccctccccgtacaacgtagtccggtacgtaccgtaacctagtttccggtacggacctaccgtaccacggcacgcctaggttcgtctacgtcgactacgtcgtaccgtctacgtccgaccggcccgccgaacgccggccgttacttagttcgtgngtacggagtagccgagcgggtaccgtaaaaccccgtactaaccccgttacgttaccgaccgtacccggtcgggggaaccctaacgggggaacccgtggtaaccctaccggtccaaccgtccacggcccc

SEQ ID NO: 425657 - DNA, 727 bp, Homo sapiens
  misc_feature: GZ8MTXP02HWBXY.25.87.H10.1.454.CMB.2.raw
  modified_base (222)..(222): a, c, t, g, unknown or other
  modified_base (236)..(236): a, c, t, g, unknown or other
  modified_base (240)..(240): a, c, t, g, unknown or other
  modified_base (245)..(245): a, c, t, g, unknown or other
  modified_base (306)..(306): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttggagacccctgtccctcacctgctctgtctctggtnactcatcacagtangctnatcgnggggctgctccgccacgcccccgaggacggcctaggagtcggattggcgtattgtcctttnagtacggtgggacgtcgtacctactaccgtacgttccccctccccgtacgtaaacggtcgttaccgagttacccgtaaccttaggtttttccggggttacaacccgtacccggttacccaaccggtcaaacgggtcctaagtttccggtacttcgtacggaaccctacgtcggtacgttctcggtaccgacccggcccgaccggaccgaccgggttccgttacttacgttaacctggggccacggtaaggaccgttacgaacgggtacccgggtaaacccgtaaaacccccttaaccggtaaaacccccctttgtttaccggaaacccttccggggtaccgggggaacccttaacgggggaaaccccgtttcgggaacccctacccggttacaacccccgttccgtacccggtaacccccg

SEQ ID NO: 425658 - DNA, 647 bp, Homo sapiens
  misc_feature: GZ8MTXP02HGIGL.25.87.H10.1.454.CMB.2.raw
  modified_base (222)..(222): a, c, t, g, unknown or other
  modified_base (247)..(247): a, c, t, g, unknown or other
  modified_base (330)..(330): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccagtatgctcattacngggctggctccgccacgcccccgagggaacggccgtggagtggattgcgtatttgtctttcataggtggatcgacctactacncgtccctcctacagagtcgacgtcacctatttcggtcacacgtccaacgcagtctagttcgtctactcgactactcgtaccgtcttcgaccgaccggcccgacccggacgtaccgggccttactaacgtttaccgtgtacgccggagtacgtcgacggtaccggtaaccgggtaaaaccccctaaaccgtaacccccgttaagtttaccgaacccgttaacccgggttacggggaccccggtaaacggggtaaaccccgttcggtacccgaaccccggttaccgaaccccttccgaccggtacccctaaacccccgg

SEQ ID NO: 425659 - DNA, 624 bp, Homo sapiens
  misc_feature: GZ8MTXP02HLOVH.25.87.H10.1.454.CMB.2.raw
  modified_base (222)..(222): a, c, t, g, unknown or other
  modified_base (376)..(376): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattacgtggggctggctccgccacgcccccgagggacggccgtggagtggattgcgtattgtctttcagtacggtgggagtcgcctactacacgtccctcccctacaagacgtcgacgtcactgtttcggtanacaccgtccacgcagcgtagttcgtctcgtacgacctacgtcgaccgttctcggttccgaaccggggcccgacccgacgtacccgggtccgttacttacgttactcggtgccgagtacgtcgaacggtccggtaaccgaaaacccctaccgtaaaccccttacgttacgaccggtaccgtacgggggacccgtaacgggggaacccgtcggtacccgtaccggtaccaacccgtcgaaccgtcccccg

SEQ ID NO: 425660 - DNA, 641 bp, Homo sapiens
  misc_feature: GZ8MTXP02JCJU4.25.87.H10.1.454.CMB.2.raw
  modified_base (242)..(242): a, c, t, g, unknown or other
  modified_base (380)..(380): a, c, t, g, unknown or other
  modified_base (393)..(393): a, c, t, g, unknown or other
  modified_base (409)..(409): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtgactcatcacagtaatgctnattcgtgggctgctccgcacgccccgaggacggcctggagtggattgcgtattgtctttcgagtaggtgggatcggacctactaccgacgttcccctacccctacgaacgtacgtcgacgtccaccgtgtttccggtnacctcgtccgacncagctagttcgtctcngacctacgtgacgttctcgaccgaccgggtcccgacccggaccgtacccgggtaccgttaccgttagttacctagggtcgacgaggtaccgtggacgggtacccgggtaacggtaaaaccccctaccgtaacccccgttagtttacccgaaccggtccggtaaccgggggccgtaaaacgggggccccgttaggttaccccgacccggtaccaccctaccggacgtcccccg

SEQ ID NO: 425661 - DNA, 622 bp, Homo sapiens
  misc_feature: GZ8MTXP02F92FE.25.87.H10.1.454.CMB.2.raw
  modified_base (222)..(222): a, c, t, g, unknown or other
  modified_base (239)..(239): a, c, t, g, unknown or other
  modified_base (243)..(243): a, c, t, g, unknown or other
  modified_base (256)..(256): a, c, t, g, unknown or other
  modified_base (485)..(485): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacctagtangctnattacgtggggcnggctccgccacgccccgaggacggctggagtgatgcgtattgtcttcagtacggtgggagtcgtacctaactaccaccgtcccctcccctactagcgtccgagtcctactagtttcggtagacctacgtaccgagtccgaagtcgttagttcgtctacgtagacctacgtgcgttacgcgtaccgaccggcccgtccgaaccgtcgggttccctattactttaaccggngtacgacgacgtacgcggaacggtcccgtaaaccctaaacccgtaccctacccgttacggtaccgaccggtaccggggtcgggaacccgtacgggtaacgttccgacccgtacccgtccgtaccgcgacccgtcccg

SEQ ID NO: 425662 - DNA, 708 bp, Homo sapiens
  misc_feature: GZ8MTXP02IC32X.25.87.H10.1.454.CMB.2.raw
  modified_base (201)..(201): a, c, t, g, unknown or other
  modified_base (210)..(210): a, c, t, g, unknown or other
  modified_base (221)..(221): a, c, t, g, unknown or other
  modified_base (232)..(232): a, c, t, g, unknown or other
  modified_base (289)..(289): a, c, t, g, unknown or other
  modified_base (291)..(291): a, c, t, g, unknown or other
  modified_base (299)..(299): a, c, t, g, unknown or other
  modified_base (367)..(367): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttggagaccctgtcccncacctgctntgtctctggtnactcatcaacngtaatgctcattacgtgggctggctccgcgacgccccgaggacggctggagtgatgngnttgtcttnagtggtgggagtcgctacgtacgctccctccctacaagtagacgtgttaccacttagtttccgggtanacccgtacgccctacggctacgacgtacgttacgtcgttacgtacgtacccgtacgtacggtaccgttcgtaccgggttacccgacccggggaacccggttccccggaaccggtaaccccggggttcccgtttacgttaacgtttaaccggttcggttacgggaccggtacggtaaacgttccggaacggggtacccggttaaccccggtaaaacccccgtacccggttaaacccccttacgtttaccggaacccgttaccgggccgggggtaacccgtaacgggggtaaccccgttacggtacccgttacccgacgtaccccgtacgaacccgtcccccg

SEQ ID NO: 425663 - DNA, 760 bp, Homo sapiens
  misc_feature: GZ8MTXP02F78MP.25.87.H10.1.454.CMB.2.raw
  modified_base (223)..(223): a, c, t, g, unknown or other
  modified_base (243)..(243): a, c, t, g, unknown or other
  modified_base (309)..(309): a, c, t, g, unknown or other
  modified_base (480)..(480): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgccagatgggtcctgtcccagctgcgtctgcaggagtcgagcccgagggcaggtgaagccttcggacgaccctgtccctcacctgctctgtctctggtnacctcatcacagtatcgctntaagttcggtgggtcgcggtccacccgccgaccggaccccggaagggaccggccgtggagttggtnttcggacgttacgtttgtttccgtttacgaagttagggtgggtagtcgtaccctacgtactacctcccctaccccctagtaagacgttcgacgtaccacgtttcgtttcgggtacacgtacccgtaccgacggacctagtcctaggtttctaactctacggaacttaccgngtacgtcgttcgacccgacggttcccccgcccgaaaccgtcccgggttacccttaccttttaaagtccgtaccggggttcgaacgggtacgtaccgtacggtaaccgggtaaccccggttaaaaccccgtaaaacccccgtttaccccttaaacccgtttacgtaacccgggtaacccgggttaccccggggtaacggggaccccggtaaaccggggttaaccggttcccggaaacccccgtacccgtaacccgtacccggtaccgtacccgtaaccccg

SEQ ID NO: 425664 - DNA, 706 bp, Homo sapiens
  misc_feature: GZ8MTXP02HG7ZT.25.87.H10.1.454.CMB.2.raw
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactcatcaccagtatgctcatacgtggggctgctccgccacgcccccgagggtacggcctggtagtggattgcgtatttgtctttcataggtgggagtcgcctaataccacgttcccctacccctacgaacgacgtaccgacgttaccacccgtttagtttccggttacgtaaccgaccgttacccgacgcgtacgacccgttaagttcggttcctcgttacgaaccgttacgtcgtaaccggttcgtccgtaccgacccgggccccgggacccgtacgaccccggggttacctaccgtttaaacgtttacccgtggttacggaccgtaggtacggttacccgtacgggacgggttaaccccgtaaaaaccccgtacccttaaccccgttactttaccggaaccgttcccggacgggggacccgtaacggggtaacccgtcggtaccgtacccgggttaccaacccgttcgaacccggtccccc

SEQ ID NO: 425665 - DNA, 499 bp, Homo sapiens
  misc_feature: GZ8MTXP02GK124.25.87.H10.1.454.CMB.2.raw
  modified_base (222)..(222): a, c, t, g, unknown or other
  modified_base (349)..(349): a, c, t, g, unknown or other
  modified_base (370)..(370): a, c, t, g, unknown or other
  modified_base (381)..(381): a, c, t, g, unknown or other
  modified_base (389)..(389): a, c, t, g, unknown or other
  modified_base (393)..(394): a, c, t, g, unknown or other
  modified_base (398)..(398): a, c, t, g, unknown or other
  modified_base (403)..(403): a, c, t, g, unknown or other
  modified_base (411)..(411): a, c, t, g, unknown or other
  modified_base (421)..(421): a, c, t, g, unknown or other
  modified_base (425)..(425): a, c, t, g, unknown or other
  modified_base (428)..(428): a, c, t, g, unknown or other
  modified_base (434)..(434): a, c, t, g, unknown or other
  modified_base (465)..(465): a, c, t, g, unknown or other
  modified_base (489)..(489): a, c, t, g, unknown or other
  modified_base (497)..(497): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcaccagtaatgctcattactggggctggctcccgcacgcccccagggaacggcctggagtggattgcgattgtctttcatagtcgggatgacctactacacgtcccctcccctacaaagngtacgagtcactagtttcgtnacacgtcacgnagcagttnctcnncacnactcngcgcgccncgactcgctntatntgngcgagngcgagtcgtaccgaacctacacctactcacnccgtcggcaggaaccgtcgacacncactcacncc

SEQ ID NO: 425666 - DNA, 662 bp, Homo sapiens
  misc_feature: GZ8MTXP02HOZ65.25.87.H10.1.454.CMB.2.raw
  modified_base (222)..(222): a, c, t, g, unknown or other
  modified_base (246)..(246): a, c, t, g, unknown or other
  modified_base (252)..(252): a, c, t, g, unknown or other
  modified_base (314)..(314): a, c, t, g, unknown or other
  modified_base (322)..(322): a, c, t, g, unknown or other
  modified_base (351)..(351): a, c, t, g, unknown or other
  modified_base (392)..(392): a, c, t, g, unknown or other
  modified_base (498)..(498): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattcgnggggcnggcctccgccaccgcccccgaggggaacggccgtaggagtggattggcgtatttcgtctttnagttaggngggagtcgtacctactacgacgttccccncccctagaaagcgtcgagtccaaccgttgttttccgggtanaccgtaccgtcccgacgacacgcgttagttcgtccttcgagacctacgtcgaacgttctacgtccgaaccggcccgaccgaccgacggttccgtacttaagttcgnggtacgacgtacgtaggtccgaagggtcccgggtaaacccggaaaacccccttaccgtaaaccccgttcgttacggaaacccgtcccgggtacgggggaaccccgtaagggggtaacccgtacgggtacctacccgacgtaccccgtaccgacggtaacccccg

SEQ ID NO: 425667 - DNA, 675 bp, Homo sapiens
  misc_feature: GZ8MTXP02GXTS8.25.87.H10.1.454.CMB.2.raw
  modified_base (223)..(223): a, c, t, g, unknown or other
  modified_base (243)..(243): a, c, t, g, unknown or other
  modified_base (250)..(250): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggacgaccctgtccctcacctgctctgtctctggtnactccatcaccagtatgctnattacgngggctggcctccgccacgccccgaggacggccgtggagtgattgcgtattgtctttacgagtaggtgggagtcgtaccctacgtaccacgttcccctcccctagaagtcgtacgacgtcctacgtgtttcggtagacctaccgtccgacgtacagtccgtagtttcgtctcgtacacctacgtcgtacgttcgtcgtcccgaccgggccccgtaccgaccgtaccgggtccttacgtttaagttccgtcggtacgaccggtaaggacggttaccgacgggtacccgggtaaacccgtaaaaccccccttaccgtaaacccccgtttacgtttaccggacccgtaccggggtaccggggaacccggtaacggggtaacccgttcggtacccgtacccggtacctacccgtaccgaccgtacccccg

SEQ ID NO: 425668 - DNA, 589 bp, Homo sapiens
  misc_feature: GZ8MTXP02GZ5CO.25.87.H10.1.454.CMB.2.raw
  modified_base (343)..(343): a, c, t, g, unknown or other
  modified_base (423)..(423): a, c, t, g, unknown or other
  modified_base (445)..(445): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggacggcctggagtggatgcgattgtcttcatagtgggagtgcctactacacgtccctcccctcaagngtcgagtccactgtttcgtgacacgtccacgcagcagttgtctctgacactgacgtctgtccgacggtcccgcccgaacncgggccgttactacgttaccgngtcgcgacgagtcgacggtccggtaccggaaaacccctaccgaaacccccttacgtttaccgaccgtacccgtcgggggacccgaaacggggtaacccgtcggttacccgacccggttaccacccgttaccgacgtaacccccg

SEQ ID NO: 425669 - DNA, 772 bp, Homo sapiens
  misc_feature: GZ8MTXP02JUABM.25.87.H10.1.454.CMB.2.raw
  modified_base (222)..(222): a, c, t, g, unknown or other
  modified_base (247)..(247): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcacagtatgctcattacgngggctggctccgccacgtcccccgagggtaacggcctggagtggattgcgtattcgttctttacgagttaggtgggtagttcgacccttaactaccgtaccgttccccctaccccttacgaacggtacgtaccgtacgtacctaaccgttcggttttccgggttacgaacccgtacccgggttaccccgaaccggccgtacgggtaccgttaacggtttttccggtcccttacgttacgtaaacccgttaccggttcggtaacccggtttcgttccggttacccggtaacccgggggtcccccggtacccggaaacccggtaccccgggggttccctttaaccgtttaaacgggtttacccgttagggttccggacggtaacggtaacgtccggaacggggtacccgggtaaaccccgtaaaaccccctaccgtaaccccgttacgttacggaccctaccgggtacgggacccgaacgggtaacccggttacggaccctaccggtacacccgtcgacctaccccg

SEQ ID NO: 425670 - DNA, 656 bp, Homo sapiens
  misc_feature: GZ8MTXP02IS05D.25.87.H10.1.454.CMB.2.raw
  modified_base (241)..(241): a, c, t, g, unknown or other
  modified_base (248)..(248): a, c, t, g, unknown or other
  modified_base (282)..(282): a, c, t, g, unknown or other
  modified_base (295)..(295): a, c, t, g, unknown or other
  modified_base (344)..(344): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcacagtatgctnattacgngggctgctccgccacgccccgaggacggctgagngatggctattgtnttcgagtagtgggactcgcctactacgacgtcccctccccctagaacgngtccgtagcctacctaggttttccgtagaaccgtacgtcggacaccggtccgaagtcccgtaaaggttttccgtcgtacgtacgaccgtacgtacgtaccgtcgtacgtaccgacccggcccgaccgaccgtaccgtccgttacgtaacgttcgtacggtcgaacgtacgtacggtaccgacggtacccggttaaacccgtaaaacccccgttaacccgtaaaccccgttacgttaccgaacccgtaccgggtcgggaacccgaacgggtaacccggtcggtacccgaccgtaccctaaccgtccgaacccg

SEQ ID NO: 425671 - DNA, 683 bp, Homo sapiens
  misc_feature: GZ8MTXP02JLZRR.25.87.H10.1.454.CMB.2.raw
  modified_base (255)..(255): a, c, t, g, unknown or other
  modified_base (264)..(264): a, c, t, g, unknown or other
  modified_base (597)..(597): a, c, t, g, unknown or other
  modified_base (663)..(663): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaacgccgttcggacgaccctcgtccctcacctgctctgtctcgtggtgacctcactcaccatatgctctattacgngggctgccnccgccaccgccccggagggacggccgtggagtggtatgcgtattcgtctttcagtacggtgggagttcgaccctacgtacctaccgttccctacccccgtagaagacgttacgtacgtacctacgttcgtttaccggtacgacctaccggttacccacgtacctacggacttaaggtttcctccctcgttacggaacctccggtagttccgtcctagttcccgaaccgggccctcccggaactccgggtcccttattacgtcggtgcggaccgtagcgtaccggacgtaccggtaaaacccgtaacccctaacctccggtaaaacttacccgngggaaacccccgtggggtaaccccggtaacggggtcccgttacccggtccgaaaccccgttacccncccgtaacctaccggacccc

SEQ ID NO: 425672 - DNA, 615 bp, Homo sapiens
  misc_feature: GZ8MTXP02GHDFN.25.87.H10.1.454.CMB.2.raw
  modified_base (191)..(191): a, c, t, g, unknown or other
  modified_base (203)..(203): a, c, t, g, unknown or other
  modified_base (217)..(217): a, c, t, g, unknown or other
  modified_base (222)..(222): a, c, t, g, unknown or other
  modified_base (241)..(241): a, c, t, g, unknown or other
  modified_base (247)..(247): a, c, t, g, unknown or other
  modified_base (255)..(255): a, c, t, g, unknown or other
  modified_base (273)..(273): a, c, t, g, unknown or other
  modified_base (291)..(291): a, c, t, g, unknown or other
  modified_base (336)..(336): a, c, t, g, unknown or other
  modified_base (473)..(473): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcgganaccctgtccctnacctgctctgtctntggtnactcatcactagtatgctnatacgngggctgcncgcacgcccgaggacgcngagtgatgctatgtcttnagtacggtggactcgtaccgtactacgtaccgtccctccccgtanaagtacgtacggtactacccacttagtttccgtacgaccgtacccgtcaacgcaacgtcgtagttcgtactcgtagactcgtcggtacctcgttacgcgaccggtcccgaccgacgtaccgtcgtacttacgttcgngtcgacgtacggtacgtcgaacgggtccgaaccgtaaaacccctaccgtacccttacgttacgaccgtaccgggtacgggacctaacgggggtaaacccttcgggaccctaccgtacctaaacctccggaaaccttcccccg

SEQ ID NO: 425673 - DNA, 599 bp, Homo sapiens
  misc_feature: GZ8MTXP02JJ6NE.25.87.H10.1.454.CMB.2.raw
  modified_base (251)..(251): a, c, t, g, unknown or other
  modified_base (344)..(344): a, c, t, g, unknown or other
  modified_base (405)..(405): a, c, t, g, unknown or other
  modified_base (468)..(468): a, c, t, g, unknown or other
  modified_base (477)..(477): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcagggtgaacgccttcggagaccctggtcccctcacctgctctgtctctggtgactccatcacagtatgctcattcgngggctggctcgccacgccccgaggacggcctggagtggattgcgtattgtcttcgataggtggagtgacctactacgtacgtccctcccctanaacgactcgactccgtactagtttcggtacgacctacgtcccaagcacgtctagttcgtcncttacaccgtattcggacttcgtagtccgaccgccgacccgacacgggtcctattacgtacgngttaccggngagtacgtcgaccggtacggaacccgtaaaacccccgtacgtaaccccttacgttacgacctaccggtacggggaccgacggaaccgttcggacccaaccgtcacccgtacacccgtacccg

SEQ ID NO: 425674 - DNA, 714 bp, Homo sapiens
  misc_feature: GZ8MTXP02GC6ZS.25.87.H10.1.454.CMB.2.raw
  modified_base (222)..(222): a, c, t, g, unknown or other
  modified_base (241)..(241): a, c, t, g, unknown or other
  modified_base (248)..(248): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnattacgngggctcggctccgccacgccccgaggacggcctggagtggatgcgtattgtctttacgagttaggtgggacgttcgaccttacgtacgtacgttcccctacccgttacaaaggtacgtacgtacgtacctaccgtagtttccggtacgtaaccgtacgtcgacgaacgggctaaacgcctaaggttcgttccgtactagtaaccacgttcgtaaccgttctcggtaccgaaccgggtcccgaccggtacccgtaccgggaccgtttacctaaacgttcgtacggtacgcggtaaacggacgttacggaacggtaccgggttaaaaccggtaaaacccccttacccgttaaaaccccctttacggttacgtaacccggtaacccggtacgggggtaacccgtaaacggggtaaaccccggtttggtaccccgtacccgtttaccgaaaacccgtttcgaacccccgg

SEQ ID NO: 425675 - DNA, 655 bp, Homo sapiens
  misc_feature: GZ8MTXP02GM3SV.25.87.H10.1.454.CMB.2.raw
  modified_base (247)..(247): a, c, t, g, unknown or other
  modified_base (260)..(260): a, c, t, g, unknown or other
  modified_base (305)..(305): a, c, t, g, unknown or other
  modified_base (311)..(311): a, c, t, g, unknown or other
  modified_base (329)..(329): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaacgccgtacggacgacccctgtcccctcacctgctctgtctcgtggtacacctcatcactaagtancgctctagtcggnggctcggcctccgccaccgacccgaggacgcgtggagtggtatgngtattnttcttgagtaggtgagtnacctataccacgttcccacccagacgtcgtacgtactacctacgttgtttaccgacgaccgtaccgtccgacgtacacgttacacgtttcggctgacacgtgtaccgtattccgtcgacccgacggacccgacccgtaccgtaccgggttccttaccgtatttccggagtaccggagtacgtaggaccgtaacgggtaacccgtaaccggtaaaaccccctacccggtttaaaccttccggttaaaccggaccgtccgggggtaacggacccgttacgggaaccgttccgacccggtaacctcgaaccccgtccgaacccgacccg

SEQ ID NO: 425676 - DNA, 723 bp, Homo sapiens
  misc_feature: GZ8MTXP02GHI5Z.25.87.H10.1.454.CMB.2.raw
  modified_base (246)..(246): a, c, t, g, unknown or other
  modified_base (253)..(253): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccgagggcaggtgaagtccttcggacgaccctgtccctcacctgctcgtgtctcgtggtcactccatcacagtatgctnattacgngggctgctccgcacgcccgagggacgctggagtgtatgcgtagttgttctttcaggttacggtgggtacgtcgtaccctaacgtaccgtaccggttcccctacccccgtaagaacgtcgtaccgagttaccctaacgttagtttccgggtaaccgtaccgtccaacgccgtagtacgtagtttcgtctacgtacgaactcgtcgtaccgttagtccggtaccgacccgggcccgaacccggaccgtacccggggttacccgtttactttaaagtttcccgacggttacggacggtaccggtaaagtcccggtaagggtaaccccgggttaaacccggtaaaaacccccttacccggttaaaaccccctttacgttaaaccggaacccgttaccggggtaccggggacccggtaaacggggtaacccggtcgtaacccgtaccccggtactaccctccgaacgtacccccg

SEQ ID NO: 425677 - DNA, 660 bp, Homo sapiens
  misc_feature: GZ8MTXP02FZ89L.25.87.H10.1.454.CMB.2.raw
  modified_base (222)..(222): a, c, t, g, unknown or other
  modified_base (241)..(241): a, c, t, g, unknown or other
  modified_base (441)..(441): a, c, t, g, unknown or other
  modified_base (451)..(451): a, c, t, g, unknown or other
  modified_base (506)..(506): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctnagttacgtggggctggctccgccgaccgccccgagggacggccgtaggagtggattggctattgttcttacagtagtgggatcgtacctactactacgtcccctacccctacgaagcgtaccgtacgtccgtaacttgtttaccgtgaacctacccgtccgtaacggcaacgtccgttagttcgtctactacgacctacncgtacgttcncgtaccgacggcccggacccggtacgaaccggttccgtacttaagttcgtacggngcggtaacgacgtacgagggtacccggtaaccggaaaacccccttaccgacccctttaagttacccgaaccggtaccgtacgggggaccctaaaccgggggtaaccgttacggtacccgtacccggacctaccctaccgtaccggaaacccccg

SEQ ID NO: 425678 - DNA, 603 bp, Homo sapiens
  misc_feature: GZ8MTXP02J25W9.25.87.H10.1.454.CMB.2.raw
  modified_base (222)..(222): a, c, t, g, unknown or other
  modified_base (347)..(347): a, c, t, g, unknown or other
  modified_base (415)..(415): a, c, t, g, unknown or other
  modified_base (470)..(470): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtnactccatcacagtatgctcattacgtggggctggctccgccacgcccccgaggacggcctggagtggattgcgtattgtctttcagttacgtgggagtgccctactacacgttcccctcccctanaagcgtcgagtccacttgtttcggttacaccacgtccaacgcgacgctaggttctcctctacggaacncgttcgaccgttcttcggccgaccggcccgccgacgacgggtcctatacttacgngtgaccgagtacgcgaggtccggtacgaaaaccccctcgaaaccccttcgtttacgaaccgccggttacgggggaccctaaacgggggaacccgttcgggtaccccaaccggttccaaccctcgacgtccccc

SEQ ID NO: 425679 - DNA, 626 bp, Homo sapiens
  misc_feature: GZ8MTXP02FM6KO.25.87.H10.1.454.CMB.2.raw
  modified_base (224)..(224): a, c, t, g, unknown or other
  modified_base (243)..(243): a, c, t, g, unknown or other
  modified_base (249)..(249): a, c, t, g, unknown or other
  modified_base (319)..(319): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgcttctgtctcgtggtnactccatcacagtatgctnattcgngggctggctccgccacgccccgaggacggctggagtggtatgcgtattgttctttacgagttaggtgggngtacgtcctaacgtacgtacgtcccctcccgtacgaagtacgtcggactaccgtaaccttgtttcggtacgaccgtaccgtccacgcacgtcgtagttcgtctcgtagactactcgtcgtcgttacgaccgccggtaccgaccgacgtcccgggtcttacgttacgttacgtcggtacgaccgaagttacgccgtacggaccggtaacccgtaaaacccctacgtacccttaaacgtttcgaaccgtaccggtacgggccgtaaacgggccgttacgtacccgtaccgtctacgaccgactaccccg

SEQ ID NO: 425680 - DNA, 671 bp, Homo sapiens
  misc_feature: GZ8MTXP02IYBMA.25.87.H10.1.454.CMB.2.raw
  modified_base (368)..(368): a, c, t, g, unknown or other
  modified_base (652)..(652): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcatacgtgggctggcctccgccacgcccccgagggaaggccgtggagtggattggctagttgtctttcaagtaggtgggatcgacctacgtactaccgtacccctccccctacgaaagtcgtacgngtaccctacctagttttcgggttacacctaccggtcccaacgcaacggcctagtttcgtacctgttggaacccacgtcgtactcgtacgtccgaccggtacccgaccgtaccgtaccggtccgttacttacgtacgtcggcggacgtagtacgtaccggtacgggtacccggtaaacccgttaaaaccccctaccttaaaccccgttacgttaaccggaacccgtaccggggtacgggtaacccgaacgggggtaacccgtcggtaccccgtacccggtacccnccctaacgtaccctacccg

SEQ ID NO: 425681 - DNA, 637 bp, Homo sapiens
  misc_feature: GZ8MTXP02FM6V3.25.87.H10.1.454.CMB.2.raw
  modified_base (222)..(222): a, c, t, g, unknown or other
  modified_base (237)..(237): a, c, t, g, unknown or other
  modified_base (240)..(240): a, c, t, g, unknown or other
  modified_base (247)..(247): a, c, t, g, unknown or other
  modified_base (281)..(281): a, c, t, g, unknown or other
  modified_base (283)..(283): a, c, t, g, unknown or other
  modified_base (286)..(286): a, c, t, g, unknown or other
  modified_base (297)..(297): a, c, t, g, unknown or other
  modified_base (472)..(472): a, c, t, g, unknown or other
tcagactgtacagtcacgaccggtgctcgatttagcagtactgcgttgggtttgggctcaactctcttgacctcctgtgcaagaacatgaagaacctgtggttcttcctcctgctggtggcggcgcccagatgggtcctgtcccagctgcgtctgcaggagtcgagcccagggcaggtgaagccttcggagaccctgtccctcacctgctctgtctctggtnactcatcaccatatnctntatacgnggctggctccgcacgccccgaggacggctggagngntgngtattgtcttnagtaggtggagtcgacctactaaccgcgtcccctcctacgaagtacgtacgtactaccaccgttgtttcggtcactaccgacctacgcgacgtcttagttgtctctagactctagccgttctcggtaccaccgggcccgaccggaccgtaaccggtcccgttcttaacgttcggngtacgcgaagtcgtacggacggtaccgggtaacccgtaaaaccccctaacgtaacccccgttattaccggaacccgtaccgggtcggggaaacccgtagggggtaaaccccggttcggtacccgaaacccggtcccaaacccgtcggacgtacccctaaccccgg

SEQ ID NO: 425682 - DNA, 558 bp, Homo sapiens
  misc_feature: GZ8MTXP02F38T8.25.87.H10.1.454.CMB.2.raw
  modified_base (239)..(239): a, c, t, g, unknown or other
  modified_base (251)..(251): a, c, t, g, unknown or other
  modified_base (297)..(297): a, c, t, g, unknown or other
  modified_base (358)..(358): a, c, t, g, unknown or other
  modified_base (406)..(406): a, c, t, g, unknown or other
  modified_base (411)..(411): a, c, t, g, unknown or other
  modified_base (501)..(501): a, c, t, g, unknown or other
  modified_base (543)..(543): a, c, t, g, unknown or other
tcagactgtacagtcacgaccggtgctcgatttagcagtactgcgttgggtttgggctcaactctcttgacctcctgtgcaagaacatgaagcacctgtgttcttcctcctgctggtggcggcgcccagatgggtcctgtcccagctgcgtctgcaggagtcgagcccagggcaggtgaagccttcggagaccctgtcccctcacctgctctgtctctggtgactccatcaccagtaangctacattacgnggggctggcctccgccacgccccccgaagggaacggccgtaggagnggtaattgcgtattgtctttcagtagtgggagtgcctactacacgtccctcccctcgaaanagtcagtaccacctagtttcggtagaccacgtccacgcagtcagtttnactcngacacgtgacgtctagacacggccgccgacgaccgggtcctcttattactgccgagagagtcagacggtacgaaaacccctcaaaccctnttacgactaccgcgggaccagggtaaccgcggtacacccgtnaccctcgacaccccg

SEQ ID NO: 425683 - DNA, 645 bp, Homo sapiens
  misc_feature: GZ8MTXP02HLSK7.25.87.H10.1.454.CMB.2.raw
  modified_base (223)..(223): a, c, t, g, unknown or other
  modified_base (250)..(250): a, c, t, g, unknown or other
  modified_base (306)..(306): a, c, t, g, unknown or other
  modified_base (332)..(332): a, c, t, g, unknown or other
  modified_base (389)..(389): a, c, t, g, unknown or other
  modified_base (407)..(407): a, c, t, g, unknown or other
tcagactgtacagtcacgaccggtgctcgatttagcagtactgcgttgggtttgggctcaactctcttgacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctcgtggtnactccatcaccagtatgctacattcgnggggctggcctcgccgacgccccgaggacggctggacgtgatgcgtattgtcttanagtagtgggtagtcgacctacgtacncgtcccctccctacgaagcgtacgacgtcacctgtttcgttagactaccgtccacgncgtacgtgttgtcctagngtacctatcggtacgtcctggaccgaaccggccgcccgtaaacgccgggtaccttacttacgttaaccgtggttacgaccggtagtacgtacggacgttacccggggaacgttaaaacccccctacgtaaacccccctttagtacccgaaccgtaacccggttcgggggaaccccgtaacgggggttaaccccgtcggtaaccctaacccgtaccgtaccccgacggtacccgtcccg

SEQ ID NO: 425684 - DNA, 496 bp, Homo sapiens
  misc_feature: GZ8MTXP01DVCXH.25.4.A04.1.454.CMB.2.raw
  modified_base (218)..(218): a, c, t, g, unknown or other
  modified_base (437)..(437): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaatattagctggtatcaaacagaaaccaggagagttcctaaagctcctgatctatgctgcctcacgttacacctcaggggtcccatctcgggttcaagcggcagtgaatctggggacagagttcactctcactatcagcagcctcgcagcctgaagaatagttgtactaacttaattacttatactaaataataataactacncctccttctacttcggttcggcggacgaacggtaggaagatacaacgaacgttgtaagg

SEQ ID NO: 425685 - DNA, 515 bp, Homo sapiens
  misc_feature: GZ8MTXP01CBCF9.25.4.A04.1.454.CMB.2.raw
  modified_base (332)..(332): a, c, t, g, unknown or other
  modified_base (401)..(401): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatatttagcctggtatcaaacagaaaccagggagagttccaagctcctgatctatgctgcctcacgttacacctcgaggggtcccatctcggttcnggcgcagtgaatcgtgggacagtagttcactctcactatcagcagccctgcagcctagaagtatggttnactaaacttattaactgtaactaaaatataaataactcgccccttcttcgtacgtttcgggacgggagggacccgaagggtaggaagtactacgaaacgtaacgttggtaacgg

SEQ ID NO: 425686 - DNA, 595 bp, Homo sapiens
  misc_feature: GZ8MTXP01DVYD6.25.4.A04.1.454.CMB.2.raw
  modified_base (219)..(219): a, c, t, g, unknown or other
  modified_base (348)..(348): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtggagacagaatcagcatcacttggccgggngagtcagggcattagactaatattagcctggtaatacaaacagaaaccagggagacgttaccaagctcctagatctatgctcgcctccacgttacacctcgagggtcccatcgtcggttcaagccgganagtagagtcgaggactagtactacactctacactacgcacgacacgcgtcgacgacgacggtagtaagtagttagttacgtacttaactttaactttaacttaacgttaaactaaaacgttaaacttaaacttaaccttaccgttacccttaccttaccgttaccggttaccgggttaccgggaacgggaaccggtaacgggtacggtaacggtaacgtaacgttaaacgtaacgttaacggtaacg

SEQ ID NO: 425687 - DNA, 490 bp, Homo sapiens
  misc_feature: GZ8MTXP01C4LSI.25.4.A04.1.454.CMB.2.raw
  modified_base (268)..(268): a, c, t, g, unknown or other
  modified_base (328)..(328): a, c, t, g, unknown or other
  modified_base (394)..(394): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttgccgggcgagtcagggcattagcaatattagcctggtatcaaacagaaacagganagttcctaagctctgatctatgctgcctcacgttacacctcagggtcccatctcggttcngcgcagtgaatctgggacaggtattcactctcactatcagcagcctgacagcctgaagtatgttanactaattatactataataaatataatctcttccctcttacgtacggtcggacgggacggaacgaagggtagaagaatacgaaacgtaacgttggtg

SEQ ID NO: 425688 - DNA, 481 bp, Homo sapiens
  misc_feature: GZ8MTXP01ALN86.25.4.A04.1.454.CMB.2.raw
  modified_base (325)..(325): a, c, t, g, unknown or other
  modified_base (383)..(383): a, c, t, g, unknown or other
  modified_base (387)..(387): a, c, t, g, unknown or other
  modified_base (458)..(458): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatattagctgtatcaacagaaaccaggagagttcctaagctcctgatctatgctgcctcacgttacactcaggggtcccatctcggttcngcggcagtgaatctgggacagagttcactctcatatcagcagcctgcagcctgaagtntgtnactacttattactagtactaaatactaataactcgttccctcttcgtacgttcggacggacggacgaaggngaagactacaacgtaacgttgtg

SEQ ID NO: 425689 - DNA, 494 bp, Homo sapiens
  misc_feature: GZ8MTXP01CJM4G.25.4.A04.1.454.CMB.2.raw
  modified_base (220)..(220): a, c, t, g, unknown or other
  modified_base (272)..(272): a, c, t, g, unknown or other
  modified_base (335)..(335): a, c, t, g, unknown or other
  modified_base (368)..(368): a, c, t, g, unknown or other
  modified_base (383)..(383): a, c, t, g, unknown or other
  modified_base (479)..(479): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgtggagacagaatcagcatcacttggccgggngagtcgagggcattagctaatatttagcctggtatcaacagaaaccaggganagttcctaagctcctgatctatgctgcctccacgttacacctcgaggggtcccatctcgttcngcgcagtgaatcgtagggacagtagttcactcncactatcagcagctncagaccgtgagtatgttgtctaacttattactatataaataataataactcttacctcttctacgttcgttcggcggaccgaaggtaggaagatanaacgtaacgaagtgg

SEQ ID NO: 425690 - DNA, 499 bp, Homo sapiens
  misc_feature: GZ8MTXP01D5M24.25.4.A04.1.454.CMB.2.raw
  modified_base (218)..(218): a, c, t, g, unknown or other
  modified_base (237)..(237): a, c, t, g, unknown or other
  modified_base (264)..(264): a, c, t, g, unknown or other
  modified_base (332)..(332): a, c, t, g, unknown or other
  modified_base (384)..(384): a, c, t, g, unknown or other
  modified_base (390)..(390): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggnagtcagggcattagcaatnttagcctggatcaacagaaaccagganagttcctaagctctgatctatgctgcctcacgttacacctcgagggtccatctcgttcaagcgcagtnaatcgtgggacagtagttcactctcactatcagcagcctgcagctagaagtntcggtnactaacttattactgtaacaaatataataactcgaccctcttcgtaccgtttcgggacgggacggaccgtaagggtggaagtaactacgaaacgtaacgttggtaacgg

SEQ ID NO: 425691 - DNA, 499 bp, Homo sapiens
  misc_feature: GZ8MTXP01EZAGW.25.4.A04.1.454.CMB.2.raw
  modified_base (219)..(219): a, c, t, g, unknown or other
  modified_base (270)..(270): a, c, t, g, unknown or other
  modified_base (330)..(330): a, c, t, g, unknown or other
  modified_base (344)..(344): a, c, t, g, unknown or other
  modified_base (368)..(368): a, c, t, g, unknown or other
  modified_base (379)..(379): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaatattagcctggtatacaaacagaaaccagganagttccaagctcctgatctatgctgcctccacgttacacctcgagggtcccatctcgtcngcgcagtgaatcgngggacagagttcactctcacttancagacacgccncgacacgacgtagaagtatagtagtactaacttattactataataaataataataactcttcctcttcgtacgttcggacggacggacgaaggtagaagacgtacgaacgtaacgttgtg

SEQ ID NO: 425692 - DNA, 568 bp, Homo sapiens
  misc_feature: GZ8MTXP01AS0NP.25.4.A04.1.454.CMB.2.raw
  modified_base (268)..(268): a, c, t, g, unknown or other
  modified_base (331)..(331): a, c, t, g, unknown or other
  modified_base (372)..(372): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatattagcctggtatcaaacagaaaccaggganagttcctaagctcctgatctatgctgcctccacgttacacctcaggggtcccatctcggttcngcggcagtgaatcgtgggacagagttcactctcacttaacncacgcacgcctcgacgacgacggtagtaagtagtagttacgtacgtaacttaacttaacttacgtaactaaagttaaacttaacttaacctaccgttcccttaccttaccgttaccggttaccgggttaccgggttacgggttaaccggtaacggtacggtaacgtaacgtaacgaacgtaacgttaacggtaacg

SEQ ID NO: 425693 - DNA, 540 bp, Homo sapiens
  misc_feature: GZ8MTXP01BG3J7.25.4.A04.1.454.CMB.2.raw
  modified_base (517)..(517): a, c, t, g, unknown or other
  modified_base (522)..(522): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactggtggagtcgtgggggaggcttggtacagccaggccggtccctgacactctcctgcacagcttcccggactcacctttggtgagcatgctatgacctgggtccgccaggcctccgaggggaagggtctggagtggctttggggttcagttagaagcgaagcctagtgggtgggggacaaacacaaaataccgccgcgtactaggtaaaaggcaaggacttcagcctctcaagagatagattaccaaaagcatcgctatctgcacatgagcagcctgagaagcggaaggaactcgagtccgttgtattacttgttcttattaactntgagngttagtggtttaattaac

SEQ ID NO: 425694 - DNA, 613 bp, Homo sapiens
  misc_feature: GZ8MTXP01EHR9Y.25.4.A04.1.454.CMB.2.raw
  modified_base (194)..(194): a, c, t, g, unknown or other
  modified_base (196)..(196): a, c, t, g, unknown or other
  modified_base (198)..(198): a, c, t, g, unknown or other
  modified_base (200)..(200): a, c, t, g, unknown or other
  modified_base (203)..(203): a, c, t, g, unknown or other
  modified_base (217)..(217): a, c, t, g, unknown or other
  modified_base (227)..(227): a, c, t, g, unknown or other
  modified_base (232)..(232): a, c, t, g, unknown or other
  modified_base (248)..(248): a, c, t, g, unknown or other
  modified_base (253)..(253): a, c, t, g, unknown or other
  modified_base (273)..(273): a, c, t, g, unknown or other
  modified_base (339)..(339): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganananancancatcacgtggcggngagtcgaggntatanataatatagctagtanacaanagaacgaggatacgtactanctactagatctatcgctacgtcctacgtacgtacacccgtacggacggtcctatccgtacgtacgnggcgagtagtagtagtacgtacggtacgtacgtacgtactactactactactactacacgacgacgacgtacgacgtacgtacggtagtaagtagttagttacgtaacttaactttaacttaacttaacgttaaactaaaacgttaaacttaaacgttaaccgttaccgttacccttacccgttaccgttaccggttaccgggttacgggaacgggttaacggtaacgggtaaggtaacgtaacgtaacgttaaacgtaacgttaacggtaacg

SEQ ID NO: 425695 - DNA, 483 bp, Homo sapiens
  misc_feature: GZ8MTXP01AG7BI.25.4.A04.1.454.CMB.2.raw
  modified_base (219)..(219): a, c, t, g, unknown or other
  modified_base (329)..(329): a, c, t, g, unknown or other
  modified_base (387)..(387): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaatattagcctggtatcaacagaaaccagggagagttcctaagctcctgatctatgctgcctcacgttacacctcaggggtcccatctcggttcngcgcagtgaatcgtgggacagagttcactctcactatcagcagcctgcagcctgaagntgttgctattatactgtacaaatataataactcgccctcttctacgttcggcgggttaggaccaaggtgaagatacgaacgtaacgttggtaacgg

SEQ ID NO: 425696 - DNA, 488 bp, Homo sapiens
  misc_feature: GZ8MTXP01DU17J.25.4.A04.1.454.CMB.2.raw
  modified_base (328)..(328): a, c, t, g, unknown or other
  modified_base (429)..(429): a, c, t, g, unknown or other
  modified_base (453)..(453): a, c, t, g, unknown or other
  modified_base (473)..(473): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatattagcctggtatcaacagaaaccaggagagttcctaagctcctgatctatgctgcctcacgttacacctcaggggtcccatctcggttcngcgcacgtgaatcgtgggacagagttcactctcactatcagcagcctgcagcctgaagatgttgctaactttattaactgtactaaaagtattaataactncccctcttctacgtttcggacggnggaccaaggtagaagactanaacgtaacgttgtgg

SEQ ID NO: 425697 - DNA, 485 bp, Homo sapiens
  misc_feature: GZ8MTXP01A8MS6.25.4.A04.1.454.CMB.2.raw
  modified_base (335)..(335): a, c, t, g, unknown or other
  modified_base (339)..(339): a, c, t, g, unknown or other
  modified_base (357)..(357): a, c, t, g, unknown or other
  modified_base (380)..(380): a, c, t, g, unknown or other
  modified_base (382)..(382): a, c, t, g, unknown or other
  modified_base (400)..(400): a, c, t, g, unknown or other
  modified_base (469)..(469): a, c, t, g, unknown or other
  modified_base (482)..(482): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcgagtcgagggcattagacaattattagcctggtatacaacagaaaccagggagagttccaagctcctgatctatgctgcctacacgttacacctcgacgggtcccatctcgttcngcgnagtgaatcgtgggacagngttcactctcatatcagcagccncncacgacgagagtatagtntactacttattatataataataatataactcttcctcttcgtacgtcgcggacggacgaaggagaaganacgaacgtaacgngtg

SEQ ID NO: 425698 - DNA, 584 bp, Homo sapiens
  misc_feature: GZ8MTXP01AV7K4.25.4.A04.1.454.CMB.2.raw
  modified_base (218)..(218): a, c, t, g, unknown or other
  modified_base (267)..(267): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaatattagcctggtatcaaacagaaaccaggganagttcctaagctcctgatctatgctgcctcacgttacacctcaggggtcccatctcgttcaagcggcagtcgaatctgggacagagttcactctcactaatcagcacgcctcgcacgccgtgaagtaagtgttagtactaacttaactttaaccttaggtaacctaaaacggttaaattaaattaaccgttaacgttaccccttacccttccctaaccgtttaccgggttaccggggttacgggggttaacccggaaacggggttaacgggtaacggtaagtacgttaaaaccggaaaccgttaacggttaacgggg

SEQ ID NO: 425699 - DNA, 529 bp, Homo sapiens
  misc_feature: GZ8MTXP01A2DOZ.25.4.A04.1.454.CMB.2.raw
  modified_base (219)..(219): a, c, t, g, unknown or other
  modified_base (338)..(338): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagctaattattagccttggtatacaaacagaaaccgagggagacgttaccaagctctgatctatgctcgcctcacgttacactcgacgggtcccatcctacggttcnggcgacagtgaatcgtgggacaggtattcactctcactactcaagcagcctacgcgacgccgtagaagtagttacgttagtacgtaacttaatttactacgttaataaattaataataactacgttccctccttcgtacgttcgttcggacggaccgaaggtaggaagagtacgaacgtaacgttgtaagg

SEQ ID NO: 425700 - DNA, 524 bp, Homo sapiens
  misc_feature: GZ8MTXP01DV1TI.25.4.A04.1.454.CMB.2.raw
  modified_base (270)..(270): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcagggcattagcaatattagcctggtatacaacagaaaccaggganagttacctaagctcctgatctatgctgcctccacgttacacctcgaggggtcccatcgtacggttcaacgcggcaggtgaatcgtaggggacagtattcactctcactatcagccagcctcgacacgacctagtaagtagtagttagtactaacttattaactagtactaaataataataactcttccctcttctacgttcggttacgggacggaccggaaggtaggaagagtacgaacgtaacgttcgtaagg

SEQ ID NO: 425701 - DNA, 509 bp, Homo sapiens
  misc_feature: GZ8MTXP01A3QBE.25.4.A04.1.454.CMB.2.raw
  modified_base (220)..(220): a, c, t, g, unknown or other
  modified_base (335)..(335): a, c, t, g, unknown or other
  modified_base (349)..(349): a, c, t, g, unknown or other
  modified_base (394)..(394): a, c, t, g, unknown or other
  modified_base (424)..(424): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcgagggcattagctaattattagcctggtatacaaacagaaaccaggagagttacctaagctcctgatctatgctgcctcacgttacacctcagggtcccatcgtcgttcngcgcagtgaatcgngggacagtattcacttctcatatcagcagctgcagcgtagacgtntgtgacaacattatactagtaactaaaatntaaataccttctaccccttcgtacctacgtttacgggcggacgggtaaccgagggtcgaagacgttaacgaaacgttaacgtggg

SEQ ID NO: 425702 - DNA, 481 bp, Homo sapiens
  misc_feature: GZ8MTXP01D5FRR.25.4.A04.1.454.CMB.2.raw
  modified_base (269)..(269): a, c, t, g, unknown or other
  modified_base (330)..(330): a, c, t, g, unknown or other
  modified_base (376)..(377): a, c, t, g, unknown or other
  modified_base (379)..(380): a, c, t, g, unknown or other
  modified_base (383)..(383): a, c, t, g, unknown or other
  modified_base (391)..(391): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttgaggacagaatcagcatcacttgccgggcgagtcagggcattagcaatatttagcctggtatcaaacagaaaccaggganagttccaagctcctgatctatgctgcctcacgttacacctcaggggtcccatctcggttcngcggcagtgaatctgggacagagttcactctcactatcagcagccnncnncgngagatgtntatactattatatataaataataataactcttcctcttcgtacgtcggacggacggacgaaggtaggaagagtacgaacgtaacgttgtg

SEQ ID NO: 425703 - DNA, 507 bp, Homo sapiens
  misc_feature: GZ8MTXP01AQ8UX.25.4.A04.1.454.CMB.2.raw
  modified_base (194)..(194): a, c, t, g, unknown or other
  modified_base (219)..(219): a, c, t, g, unknown or other
  modified_base (267)..(267): a, c, t, g, unknown or other
  modified_base (332)..(332): a, c, t, g, unknown or other
  modified_base (426)..(426): a, c, t, g, unknown or other
  modified_base (436)..(436): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggnagtcagggcattagcaatattagcctggatcaaacagaaaccaggganagttcctaagctcctgatctatgctgcctccacgttacacctcgaggggtcccatcgtcggttcnggcgcagtgaatcgtgggacagtagttcactctcactatcagcagcctgcagccgtagaagtatgttgactaacttattactagtactaaaatntaaatctacnccctcttcgtaccgtttcgggacggagggacccgaagggttggaagtactacgaaaccgtaagttggtcgg

SEQ ID NO: 425704 - DNA, 541 bp, Homo sapiens
  misc_feature: GZ8MTXP01CTFZH.25.4.A04.1.454.CMB.2.raw
  modified_base (335)..(335): a, c, t, g, unknown or other
  modified_base (383)..(383): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatattagcctggtatcaaacagaaaccagggagagttcctaaagctcctgatctaatgctgcctccacgttacacctcaggggtcccatctacggttcngcgcagtgaatcgtgggacagtagtcactcttcactatccagcagccncgcacgacgtacgtagtagtagttagtactaacttaattaacttacgtaactaaagtaaactaactaactaccgttaccctccttaccgtacgttacggttacgggacgggaacggtaagggtaggaacgaacgtaacgaaacgtaacgttaacggtg

SEQ ID NO: 425705 - DNA, 544 bp, Homo sapiens
  misc_feature: GZ8MTXP01EP3MG.25.4.A04.1.454.CMB.2.raw
  modified_base (220)..(220): a, c, t, g, unknown or other
  modified_base (357)..(357): a, c, t, g, unknown or other
  modified_base (382)..(382): a, c, t, g, unknown or other
  modified_base (385)..(385): a, c, t, g, unknown or other
  modified_base (391)..(391): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcagggcattagctaattattagcctggtatcaaacagaaaccagggagagttaccaagctcctgatctatgctgccctacacgttacacctcgacggggtcccagtcgtacggttcaaggcgcagtgaatcgngggacagagtcactctcacttaacncancacgcncgacgacgacgtagtaagtagtagtacgtactaacttaacttaactaactaataaactaaacttaactaactaccgttcctacttacgtacgttacgggttacgggacggacggtaaggtaggtaacgtaacgtaacgaacgtaacgttcgtg

SEQ ID NO: 425706 - DNA, 507 bp, Homo sapiens
  misc_feature: GZ8MTXP01ADJDY.25.4.A04.1.454.CMB.2.raw
  modified_base (218)..(218): a, c, t, g, unknown or other
  modified_base (329)..(329): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggnagtcagggcattagcaatattagcctggtatcaaacagaaaccagggagagttcctaagctcctgatctatgctgcctcacgttacacctcaggggtcccatctcggttcngcggcagtgaatctgggacagagtcactctcactatcagcagcctgcagcctagaagtatgttagcctaacttattaccgtgtactaaaatataataactcgccccttcttcgtacgtttcggcgggacgggacccgtaagggtggaagacgtacgaaacgtaacgttaaggttcggg

SEQ ID NO: 425707 - DNA, 535 bp, Homo sapiens
  misc_feature: GZ8MTXP01DTGJN.25.4.A04.1.454.CMB.2.raw
  modified_base (222)..(222): a, c, t, g, unknown or other
  modified_base (409)..(409): a, c, t, g, unknown or other
  modified_base (417)..(417): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacgttggccgggngagtcgagggcattagctaattatttagcctggtatacaaacagaaaccagggaagagttacctaagctcctgatctatgctgcctcacgttacactcgacggggtcccatctcggttcaaggtcgcagtgaatcgtgggacagattcactctacactatcagcagccctggcacgccgtagaagtnttggttanactaactttattaactgttaaacaaaattataactaactccttacccttcttacgtacgtttcgggcgggagggttaaccgaagggtacggaatacgacgaaacgtaacgttggtaag

SEQ ID NO: 425708 - DNA, 574 bp, Homo sapiens
  misc_feature: GZ8MTXP01DZ2L8.25.4.A04.1.454.CMB.2.raw
  modified_base (403)..(403): a, c, t, g, unknown or other
  modified_base (410)..(410): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagcttcccggactcacctttggtgagcatgctatgacctgggtccgcaggctccgagggaggtctggagtggctttgggttcagttagaagcgaagcctagtgggtggggcaacacaaatacgccgcgtctagtaaaggcagattcagcctntacaagngatagattaccaaagcatcgactatctgcacagtgacgcacgaccctaggaaggaacggcggaagggaaccttcgaggtcccgtttagttactttaaccgttgttttcctttaatttaaccttcgttaagtaaggtagttaggtttaacggttttaattttaac

SEQ ID NO: 425709 - DNA, 534 bp, Homo sapiens
  misc_feature: GZ8MTXP01BGDB1.25.4.A04.1.454.CMB.2.raw
  modified_base (220)..(220): a, c, t, g, unknown or other
  modified_base (242)..(242): a, c, t, g, unknown or other
  modified_base (260)..(260): a, c, t, g, unknown or other
  modified_base (272)..(272): a, c, t, g, unknown or other
  modified_base (285)..(285): a, c, t, g, unknown or other
  modified_base (337)..(337): a, c, t, g, unknown or other
  modified_base (401)..(401): a, c, t, g, unknown or other
  modified_base (444)..(444): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcagggcattagctaattnttagcctggtatacaaanagaaacaggganagttccaagctcngatctatgctgcctcacgttacacctcgacgggtcccattccgtacggttcngcggacaggtgaatcgtagggactagtgttcactctacactatcagctagcctgacacgcgtanaacggtattggtatactaactttattactataactaaaagttntaactaactccttccccttattccgtacggtttcgggacggacgggaaccgaagggtcgaaggtactacgaaaaccgtaagttcggtcgg

SEQ ID NO: 425710 - DNA, 526 bp, Homo sapiens
  misc_feature: GZ8MTXP01CLEL9.25.4.A04.1.454.CMB.2.raw
  modified_base (219)..(219): a, c, t, g, unknown or other
  modified_base (270)..(270): a, c, t, g, unknown or other
  modified_base (333)..(333): a, c, t, g, unknown or other
  modified_base (396)..(396): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaatattagcctggtatcaaacagaaaccaggganagttcctaagctcctgatctatgctgcctcacgttacacctcgagggtcccatcctcggttcngcggcagtgaatcgtgggacagagttcactctcactatcagcagccctgcagccgtagaagtntgttgactattattactgtacaaaagtataactaactcgacccctcttaccgttaacgtttcgggacgggacgggacccgtaaaggggtcggtaacgaacgttacgaaaacccggtaagttcggtccggg

SEQ ID NO: 425711 - DNA, 586 bp, Homo sapiens
  misc_feature: GZ8MTXP01CCX84.25.4.A04.1.454.CMB.2.raw
  modified_base (219)..(219): a, c, t, g, unknown or other
  modified_base (394)..(394): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaattattagcctggtatacaaacagaaaccagggagacttcctaagctcctgtatctatgctcgcctaccacgttacacctcgacggggtcccatcgtacggttcaagcgcagtgaatcgtagggacagacgttcactcacacgtaatcagcacgccncgacgacgacggtagtagtagtacgtacgtacttaacttaacttaacttaacgtaaataaataaacttaacttaacctaccgttacccttaccgttaccgttaccggttaccgggttaccgggttaacgggttaacggtaacgggtaacggtaacgtaacgtaacgttaaaccgtaacgttaacggtaacgg

SEQ ID NO: 425712 - DNA, 491 bp, Homo sapiens
  misc_feature: GZ8MTXP01DYXFU.25.4.A04.1.454.CMB.2.raw
  modified_base (219)..(219): a, c, t, g, unknown or other
  modified_base (328)..(328): a, c, t, g, unknown or other
  modified_base (474)..(474): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaatattagcctggtatcaaacagaaacaggagagtcctaagctcctgatctatgctgcctccacgtacacctcacggggtcccatctcggttcngcgcagtgaatcgtgggacagattcactctcactatcagcagctgacagccgtgagatagtgactaacttaattaacttatataaataataataactacttccctcttctacgttcggttacggcggaccgaaggtaggaaggaanacgaacgtaacgttgtg

SEQ ID NO: 425713 - DNA, 505 bp, Homo sapiens
  misc_feature: GZ8MTXP01B8ZZF.25.4.A04.1.454.CMB.2.raw
  modified_base (219)..(219): a, c, t, g, unknown or other
  modified_base (271)..(271): a, c, t, g, unknown or other
  modified_base (335)..(335): a, c, t, g, unknown or other
  modified_base (463)..(463): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaatatttagcctggtatacaaacagaaaccaggganagttcctaaagctcctagatctatgctgcctcacgtacacctcgaggggtcccatctcggttcngcgcagtgaatcgtgggacagtagttcactctcactatcagcacgcctgcagccgtagaagattgtagacctaattattaactgtaactaaagtataataactcgccctcttctacgttcggacgggnggaccgaagggtggaagactacgaaacgtaacgttggtaacg

SEQ ID NO: 425714 - DNA, 563 bp, Homo sapiens
  misc_feature: GZ8MTXP01C5PJJ.25.4.A04.1.454.CMB.2.raw
  modified_base (220)..(220): a, c, t, g, unknown or other
  modified_base (270)..(270): a, c, t, g, unknown or other
  modified_base (290)..(290): a, c, t, g, unknown or other
  modified_base (330)..(330): a, c, t, g, unknown or other
  modified_base (335)..(335): a, c, t, g, unknown or other
  modified_base (365)..(365): a, c, t, g, unknown or other
  modified_base (380)..(380): a, c, t, g, unknown or other
  modified_base (387)..(387): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcgagggcattagctaatattagcctggtatcaaacagaaacaggganagtcctaagctctgatctangctgcctcacgttacacctcgagggtccatctacggttcngcggnagtgaatcgtagggacagtacttcaacttnactaactatccgganacacgcncgacacgacggtacgtaagtagtagtacgtaactaacttaacttaacttaacgtaaactaaagtaaactaaacttaacttaccgttacccttaccttaccgttaccgttacgggttacgggttacggaacggtaaggtaggtaacgaacgtaacgttaaacgtaacgttaacgtcg

SEQ ID NO: 425715 - DNA, 556 bp, Homo sapiens
  misc_feature: GZ8MTXP01B5C0J.25.4.A04.1.454.CMB.2.raw
  modified_base (416)..(416): a, c, t, g, unknown or other
  modified_base (422)..(422): a, c, t, g, unknown or other
  modified_base (429)..(429): a, c, t, g, unknown or other
  modified_base (431)..(431): a, c, t, g, unknown or other
  modified_base (441)..(441): a, c, t, g, unknown or other
  modified_base (453)..(453): a, c, t, g, unknown or other
  modified_base (459)..(459): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgcttagttttaaaaggtgtccaatgtgaggtgcaatggtggagtcgtgggggagcttggtacagccaggccggtcctgacactctcctgcacagcttccggactctaccgttggtgagcatgctagtcgaccgtgggtccgccgaggcctaccgaggggaagggtctgggagtgggctttgggttcaagttagaagcgaacgctagtgggtgggacaaaagacaatacgcgctacagtaaaaggcaagattcanctcaanaagagananactaacaaancatcgactatcnacacangagacacgtcgagagaagaacgacgacgtacgacgtcgtacgttacgttacgttacgtttaacttattaacttacgtagttagtaagttaagttaag

SEQ ID NO: 425716 - DNA, 522 bp, Homo sapiens
  misc_feature: GZ8MTXP01BZCZG.25.4.A04.1.454.CMB.2.raw
  modified_base (220)..(220): a, c, t, g, unknown or other
  modified_base (333)..(333): a, c, t, g, unknown or other
  modified_base (407)..(407): a, c, t, g, unknown or other
  modified_base (450)..(450): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcgagggcattagcaatattagcctggtatcaaacagaaaccagggagagttcctaagctcctgatctatgctgcctcacgttacacctcaggggtcccatctcggttcnggcgcagtgaatcgtggggacagagttcactctcactaatcagtcagcctgacacgcctagaacgtatggttanactaacttattactgtactaaaagtataataactacgcccctnttcgtacgtttcgggacgggttcgggaaccgtaagggtcggaagtacgtacgaaacgtaacgttggtaacgg

SEQ ID NO: 425717 - DNA, 539 bp, Homo sapiens
  misc_feature: GZ8MTXP01A01JO.25.4.A04.1.454.CMB.2.raw
  modified_base (276)..(276): a, c, t, g, unknown or other
  modified_base (457)..(457): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtcctgacactctcctgcacagcttccggactcacctttggngagcatgctatgacctgggcccgcaggctccgaggggaggtctgggagtggcgttggggttcagttagaagcgaacgcctagtgggtgggacaaacacaatccgccgcgtctaggtaaaaggcaagacttcagcctactacaagagatgaacttaccaaaagcaatccgactatctgcacntcgagcagccgtagacgaaggcgtaagggactcgacgtccgtgttattcttgtttcttattaactctggagtgttgtttaag

SEQ ID NO: 425718 - DNA, 571 bp, Homo sapiens
  misc_feature: GZ8MTXP01DRVO7.25.4.A04.1.454.CMB.2.raw
  modified_base (279)..(279): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtggggggagcttggtacagccaggcccggtccctgacactctcctgcacagccttccggactcacttggngagcatgctatcgaccgtgggtccgccaggcctccgagggggaaggtctggagtggcgtttgggtcagttagaagcgaacgtccctagtgggtggggacaaacgaaacaagtaaccgcccgtcgtactaggtaaaacggcaagtacttcagcctactacaagagatagattaccaaagcatcgaccttagtctgacacatgagcagcctaggaacgacggcgaaggcttgacgttccgtagttattacgttgttaccttaattactgtagtagttagttaagttcgttttaa

SEQ ID NO: 425719 - DNA, 681 bp, Homo sapiens
  misc_feature: GZ8MTXP01DA37F.25.4.A04.1.454.CMB.2.raw
  modified_base (222)..(222): a, c, t, g, unknown or other
  modified_base (284)..(284): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcattctgttggagacagaatcagcatcacgttggccgggngagtcgagggctattagactaattattaagccttggtaatacaaacaaggaaaccagggaanagttactaagctcctagatctatgactgccctacctacgttaccacccgtcgacggggtccctacgtcgtcggttacaaggtcggcgtaaggtgaaacgttcggtagggaacctaggtactttaccacttctacctaaacgtaattccgaaggcctaacgtcccgtcgacgaccggtaccgtaagggtaaacggttattacggttacaacctttaaaccgttttatttaaaccttaaggttaaaaccgtaaaagtttaacttaaacgttaaaccctcccggttacccccttaccgttaccggttaacccggtttacgggggttaacggggaccgggaaaccggtaaagggtaggaacgtaaacgtacggttaaaaccggtaaccggttggtaaccgg

SEQ ID NO: 425720 - DNA, 591 bp, Homo sapiens
  misc_feature: GZ8MTXP01E5VNX.25.4.A04.1.454.CMB.2.raw
  modified_base (375)..(375): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaatatttagcctggtatcaaacagaaaccagggagagttccaagctcctgatctatgctgcctccacgttacacctcgaggggtcccatctacggttcaagcggcagtgaatctagggacagattcactctacaaccttanacagacacgtccgtacgacgacgacggtagtaagtagttacgttacgtaacttaaactttaactttaacttaacgtaaactaaaacgttaaacttaaacttaacctacccgttaccctaccgttaccgttaccggttacgggttacggggttaacggggaaccggtaacgggtaggtaacgtaacgtaacgttaaacgtaacgttaacggtaacgg

SEQ ID NO: 425721 - DNA, 561 bp, Homo sapiens
  misc_feature: GZ8MTXP01D0TXY.25.4.A04.1.454.CMB.2.raw
  modified_base (432)..(432): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttctttttccttgttgcttgttttaaaaggtgtccaatgtgaggtgcaactggtggagtcgtgggggaggcttggtacagccaggccggtccctgacactctcctgcacagcttccggactctacctttggtgagcatgctatcgaccgtgggtcccgcaggctccgagggaggtctggagtggtcgttgggttcagttagagcgaagcctagtgggtggggacaaacacaaaacgtaccgccgcgtacctaaggtaaaacggctaagattcagcctctacaaganagtagacttacaaaagcatcgtactactctgacacagtgagcagcctagagaagcggaggaactcgagtccgttagttacttcttgtttcttattaacctgtgtaggtagttaggttgtttaatttaac

SEQ ID NO: 425722 - DNA, 531 bp, Homo sapiens
  misc_feature: GZ8MTXP01EESLP.25.4.A04.1.454.CMB.2.raw
  modified_base (194)..(194): a, c, t, g, unknown or other
  modified_base (262)..(262): a, c, t, g, unknown or other
  modified_base (267)..(267): a, c, t, g, unknown or other
  modified_base (329)..(329): a, c, t, g, unknown or other
  modified_base (397)..(397): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcagggcattagcaatattagcctgtatcaacagaaaccnggganagttcctaagctacctgatctatgctgcctcacgttacacctcgacgggtccatctcgttcnggcgcagtgaatcgtagggacagtagttcactctacactaatcagcagccctgcacgccgtagaagtnttacggttagactaaactttattaactagtaaacctaaaagttactaaataactacgcccttacttcgtacgtttcgggacgggttacgggaccgtaaggggtcgaagtacacgaaacgtaacgttggtaacgg

SEQ ID NO: 425723 - DNA, 526 bp, Homo sapiens
  misc_feature: GZ8MTXP01EFIAT.25.4.A04.1.454.CMB.2.raw
  modified_base (221)..(221): a, c, t, g, unknown or other
  modified_base (403)..(403): a, c, t, g, unknown or other
  modified_base (415)..(415): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggngagtcgagggcattagctaattattagcctggtaatacaaacagaaacgagggagtagttccaagctctgatctatgctcgcctacacgtacacctcgacggggtcccatccgtcggttcaaggtcggctagtgtaatcggaggggacagtacgttcactctcactatcagcagccctgacnggcctagaagtnttggtacactaatttataactagtaacaaatataataactcgccctcttacgtacgtttcgggcggttacggaccgtaaggtggaagtactacgaaacgtcgttggtaacg

SEQ ID NO: 425724 - DNA, 479 bp, Homo sapiens
  misc_feature: GZ8MTXP01DGVYE.25.4.A04.1.454.CMB.2.raw
  modified_base (194)..(194): a, c, t, g, unknown or other
  modified_base (268)..(268): a, c, t, g, unknown or other
  modified_base (331)..(331): a, c, t, g, unknown or other
  modified_base (378)..(379): a, c, t, g, unknown or other
  modified_base (381)..(381): a, c, t, g, unknown or other
  modified_base (395)..(395): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcagtcagggcattagcaatattagcctggtatcaaacagaaaccaggganagttcctaagctctgatctatgctgcctcacgttacacctcacggggtcccatctacggttcngcgcagtgaatctggggacagtagttcactctcactatcagcagccnncngcgtgagtatagtntatattattatatataatataataactcttcctcttcgtacgtcggcggacggacgaaggagaagatacgaacgtaacgttgtg

SEQ ID NO: 425725 - DNA, 526 bp, Homo sapiens
  misc_feature: GZ8MTXP01D5LL6.25.4.A04.1.454.CMB.2.raw
  modified_base (511)..(511): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactggtggagtcgtgggggagcttggtacagccaggccggtccctgacactctcctgcacagcttccggactcacctttggtgagcatgctatgacctgggtcccgccaggctccgaggggaagggtctgggagtgggcttggggttcagttagaagcgaagcctagtgggtggggcaaaacacaatacgccgacgtctaggtaaaaggcagattcagcctctacaagagatgacttaccaaaagcaatcgacctatctgcacatgagcagcctagagaagcgaggctcagccgtgttattcttgttcttattaactntgagtgttgtttaag

SEQ ID NO: 425726 - DNA, 578 bp, Homo sapiens
  misc_feature: GZ8MTXP01D5TG4.25.4.A04.1.454.CMB.2.raw
  modified_base (549)..(549): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtggggggagcttggacagccaggccggtccctgaccactctcctgcacagccttcccggactcacctttggtgagcatgctatgaccgtgggtcccgccgaggcctccgaggggaagggtctggagtggtcgtttgggttacagttagaagcgaaagcctagtgggtgggacaacacaaactaccgccgcgtacgtaggtaaaacggcagtattcagcctcacaagagatagaacttaccaaaagcaatcacctatctgacactagagagacgacgaccgagaaggaagacggaggaacgtacgacgtccgttcgttagttacttcgtttctttattaactntgtagtagttagttaagtttaagttttaa

SEQ ID NO: 425727 - DNA, 528 bp, Homo sapiens
  misc_feature: GZ8MTXP01BGSFA.25.4.A04.1.454.CMB.2.raw
  modified_base (298)..(298): a, c, t, g, unknown or other
  modified_base (514)..(514): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagttgggcttaactgtcttttccttgttgctgtttaaaggtgtccaatgtgaggtgcaactggtggagtcgtgggggaggcttggtacagccaggccggtccctgacactctcctgcacagcttccggactcacctttggtgagcatgctatgacctgggtccnccaggctccgaggggaagggtctgggagtgggcttggggttcagttagaagcgaaagcctagtggggtaggggcaaaacgacaagtccgccggacgttcgaggtaaaagggcaagattcagccttcacaagaagatgattaccaaaagcatccgctatctgcacatgagcagctgagagcgaggctcagcgtgttattcttgttcttataactctnagtaagttgttaag

SEQ ID NO: 425728 - DNA, 694 bp, Homo sapiens
  misc_feature: GZ8MTXP01COFOE.25.4.A04.1.454.CMB.2.raw
  modified_base (195)..(195): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttgganacagaatcagcatcacgttggccgggcgagtcgagggcatagactaattattagcctaggtactacaaacaggaaaccgagggagagttaccaagctcctgatctatgctcgcctaccacgttacacccgtcgacggggtccctatcgtccgggttacaacggcgggacctaggtacgtaacgttcgaggggacctaggtacgtttaccaccttactaccgtaactacttacaacggtccaacggccccttaggaccttaacgaccggttaagtaaacggtactttagggttactaccgttaaaccgtttagtttaaacctaaaggttaaacctaaaaaaggtttaaacttaaaccgttaaccgtttaacccgttaaccccccgtttcttacccgggttaaacccggttttcggggaaccggggaacggggttaacccgtaaagggggttaccgaagtaacgtaacgttaaaaccgggtaaaccgtttgggtaaccggg

SEQ ID NO: 425729 - DNA, 555 bp, Homo sapiens
  misc_feature: GZ8MTXP01DLKTZ.25.4.A04.1.454.CMB.2.raw
  modified_base (336)..(336): a, c, t, g, unknown or other
  modified_base (536)..(536): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaactggtggagtcgtgggggagcttggtacagccaggccggtcccctgacactctcctgcacagcttccggactcacctttggtgagcatgctatgacctgggtcccgccgaggctccgaggggaaggtctgggagtggngttgggtcagttagagcgaacgcctagtggtggggacaaaacacaagtaccgccgacgtcgtagtaaaaggcagacttcagcctctacaaagagatagacttaccaaaacgtcaatccgccttaactctagcaacatgagacagcctaggagaaggcgaggactcgacgtccgtgttatttcttagtttcttattaactntgttagtgttaagtttaag

SEQ ID NO: 425730 - DNA, 596 bp, Homo sapiens
  misc_feature: GZ8MTXP01D9CDQ.25.4.A04.1.454.CMB.2.raw
  modified_base (394)..(394): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacgttggccgggcgagtcgagggcagttagctaattattagccttggtaatacaaacaaggaaaccagggagtacgttcctaagcctctgatctatgctcgcctcacgttacaccgtcgacgggtcccatcgtcggttcaacggcgcagtcgtaagtcgtagggacagtattcactctcaacttacncgacgcacgcctgacgtacgtacggtaagtaagtattacgttactaaccttaaactttaagttaaactagttaaaactaaagttaactaactaaccgtccgttccccttacgttaccgttaccggttacgggggacgggttaacgggttaaccggtaagggtacggaacgtaacgtaacgttaacggtaacgttgggtaacg

SEQ ID NO: 425731 - DNA, 607 bp, Homo sapiens
  misc_feature: GZ8MTXP01B8GLX.25.4.A04.1.454.CMB.2.raw
  modified_base (195)..(195): a, c, t, g, unknown or other
  modified_base (220)..(220): a, c, t, g, unknown or other
  modified_base (367)..(367): a, c, t, g, unknown or other
  modified_base (418)..(418): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttgganacagaatcagcatcacttggccggngagtcgaggcattagctaatattagcctgtatacaaacagaaaccgagggaagtacgtttaccaagtctaccctagtacttctaagtcgcttacgccctaccacgttaccacccgttcggacggggtccctagtccgttcgggttcnggtcgacgtagtacgaattcgagggaactgtacgttcacttctcaattacncacgcacgtctcgacgacgtacgtaggtaagttgttacgtaactaacttaaacgtttacttaacgtaagtaaactaaagttactaactaacctccgttcccttacgttaccgttaccgggttacgggacgggttaacggaacggtaagggtacgaacgtaacgtaacgttaaacggtcgttcggtaacg

SEQ ID NO: 425732 - DNA, 569 bp, Homo sapiens
  misc_feature: GZ8MTXP01AIKSR.25.4.A04.1.454.CMB.2.raw
  modified_base (219)..(219): a, c, t, g, unknown or other
  modified_base (309)..(309): a, c, t, g, unknown or other
  modified_base (335)..(335): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaatattagcctggtatacaaacagaaaccagggagagttcctaagctcctagatctatgctgcctccacgttacncctcgaggggtcccatcgtcggttcngtcgcagtgaatcgtagggacagtagttcactctcactatcagcacgcctgctacgccgtagaaggtatggttanactaactttacttaactcgtaactaaaagttacttaactaaccttcggttccccttacttaccgtaaccggttttccggggaccgggttaacggggaacccgtaaaggggttgggaaacgtaacgttaaccgaaaacggtaaccgttaaggggttccgg

SEQ ID NO: 425733 - DNA, 551 bp, Homo sapiens
  misc_feature: GZ8MTXP01BZYH3.25.4.A04.1.454.CMB.2.raw
  modified_base (193)..(193): a, c, t, g, unknown or other
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtgganacagaatcagcatcacgttggccgggcagtcgagggcattagctaattattagcctaggtatacaaacagaaaccagggagagttccaagctctgatctatgctgcctcacgtacactcgagggtcccagtctcggttcncgcgcacgtgaactcgtagggacagtatttcactctacactagtcagcagcctagacacgccgtagtaaggtaattcgttagtaactaacctttaattaaccgttaagtaacctaaaaagttacttaaacttaacctccgttacccctcttaccgtacgtttcgggacgggacgggttaccgaaggtggaaggaactacgaaaacgtcgttgtaacgg

SEQ ID NO: 425734 - DNA, 545 bp, Homo sapiens
  misc_feature: GZ8MTXP01DX2ZN.25.4.A04.1.454.CMB.2.raw
  modified_base (219)..(219): a, c, t, g, unknown or other
  modified_base (332)..(332): a, c, t, g, unknown or other
  modified_base (340)..(340): a, c, t, g, unknown or other
  modified_base (378)..(378): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaatattagcctggtatacaaacagaaaaccagggagagttcctaagctcctgatctatgctgcctcacgttacacctcaggggtcccatctcgttcngcgcagtnaatcgtgggacagattcactctcatatcaagcacgccncgacacgacgtagagtagtagtacgtactaacttaattaactaacgtaataaagtaaacttaacttaactaccttacccttaccttaccgttacgttacgggttacgggttacgggttaacggtaagggtacggtaacgtaacgtaacgaaacgtaacgttaacgtg

SEQ ID NO: 425735 - DNA, 523 bp, Homo sapiens
  misc_feature: GZ8MTXP01CZFJD.25.4.A04.1.454.CMB.2.raw
  modified_base (298)..(298): a, c, t, g, unknown or other
  modified_base (384)..(384): a, c, t, g, unknown or other
  modified_base (441)..(441): a, c, t, g, unknown or other
  modified_base (506)..(506): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaagtgtccaatgtgagtgcaactggtggagtcgtgggggagcttggtacagccaggccggtccctgacactctcctgcacagcttccggactcaccttggtgagcatgctatgacctgggtccnccaggctccgagggaagggtctgggagtgggcttgggttcagttagaagcgaacgcctagtggtggggcaaaacacaatacgccgngtctagtaaaagcagattcagcctctcaagagatagattaccaaaagcaatcgctanctgcacatgagcagcctagagaagcgaggactcgagtcccgtgttaacgttcttgttctattctntgagtaagttgtttaag

SEQ ID NO: 425736 - DNA, 504 bp, Homo sapiens
  misc_feature: GZ8MTXP01EWMYZ.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggcgagtcagggcattagcaatattagcctggtatcaaacagaaaccagggagagttcctaagctcctgatctatgctgcctccacgttacacctcgaggggtcccatctcgttcaagcgcagtgaatcgtgggacagtagttcactctcactatcagcagcctgcagccgtgaagtatgttgactaacttattactagtactaaatataatctacgcccctcttcgacgtttcgggacggttacgggaccgtaagggtgaagactacaacgtaacgttggtaacgg

SEQ ID NO: 425737 - DNA, 532 bp, Homo sapiens
  misc_feature: GZ8MTXP01B3RHV.25.4.A04.1.454.CMB.2.raw
  modified_base (219)..(219): a, c, t, g, unknown or other
  modified_base (378)..(378): a, c, t, g, unknown or other
  modified_base (389)..(389): a, c, t, g, unknown or other
tcagactgtacagtcacgaccggtgctcgatttagagtagtgatcagggggcagaagtctctctcagtcaggacacagcatggacattagggtccctgctcagctcctgggactcctgctgctctggctcccagataccagatgtgacgtccagatgacccagtctccatcctcctgtctgcatctgttggagacagaatcagcatcacgttgccgggnagtcgagggcattagctaattattagcctaggtatacaacagaaaccgagggagagttcaagctctgatctatgctcgcctaccacgttacactccgacggggtccatctcggttcagcgcagtgaactgtggggacagtacgttcactctacacttanacagcacgccncgacgacgacgaggtagtagttagttacgtactaacttaacttaactacgtaactaaataataactactcctccttctcgttacgtacggtacgggacgggacggacggtaaggagaacgtaacgaacgttacgtcgttgtcg

SEQ ID NO: 425738 - DNA, 705 bp, Homo sapiens
  misc_feature: GZ8MTXP01DBEWL.25.4.A04.1.454.CMB.2.raw
  modified_base (279)..(279): a, c, t, g, unknown or other
  modified_base (304)..(304): a, c, t, g, unknown or other
  modified_base (356)..(356): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaacatggagtttggcttaactgttcttttcttgttgcttagttttaaaaggtgtccaatgtgaggtgcaatggtggagtcgtggggagcttggtacagccaggccggtcctgacactctcctgcacagtcttccggactctacgtttggtgancatcgactagtcgaccgtcggcccncgacggccgtacggaaggggtacggtcgtagggtagttggtcgtttgggtanaagttaagaacgacgaacgtcgtaggtgggacggaacaaaaacgaacgtaacgtaccggccggtacgttaacgtaaaggtaaaacggctaaagtacttacgacgtaccctacgtaacgaaaggtaagtaacgtaacgtaaactaaaccgaaaacgtacctaacgtacccgtaccgttacgttaccgtacgacaacgtaagtacgacgacgacgtaccgtaacggaaacggaaacggaacggaacggttaccgtaccgttaccggtaccgttaacgttaacgtttacgtttacgtttaactttacgtttaacgttacgttacggttaacggttaaggtttaaggtttaag

SEQ ID NO: 425739 - DNA, 560 bp, Homo sapiens
  misc_feature: GZ8MTXP01BWYGI.25.4.A04.1.454.CMB.2.raw
  modified_base (275)..(275): a, c, t, g, unknown or other
  modified_base (298)..(298): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagcttccggactctacctttggngagcatgctatgaccgtggtccncaggctccgagggaggtctggagtggcttgggtcagttagaagcgaagcctagtgggtgggacaacacaaaactaccgccgcgtactaggtaaaacgggcaaggacttcagtcctctacgaagagtatagtattaccaaaagcaatccgactatctgacacatgagcagcctgagaagcgaggaactcgagtccgttagttaacttacttgtttctttacttaactctaagtaagttaggttagtttaaggtttaatttaac

SEQ ID NO: 425740 - DNA, 552 bp, Homo sapiens
  misc_feature: GZ8MTXP01B5KB7.25.4.A04.1.454.CMB.2.raw
  modified_base (219)..(219): a, c, t, g, unknown or other
  modified_base (341)..(341): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagctaatattagcctggtatacaaacagaaaccagggatagttacctaagctcctagattctatcgactcgccctacacgttaccacctcgagggtcccatcgtcgttcngcgcagtagatcgtgggacagtacgtcactcacactatcagcacgcctgccagtccgtagaagtatggttactactaaactttattaactgtaaactaaaattactaacttaactccgttaccccttcttacgtaacgtttcggggaccgggagggttaacccgaagggttacgggaataacgttacgaaaacggtaaccgtttggggtcg

SEQ ID NO: 425741 - DNA, 542 bp, Homo sapiens
  misc_feature: GZ8MTXP01EOSNA.25.4.A04.1.454.CMB.2.raw
  modified_base (423)..(423): a, c, t, g, unknown or other
  modified_base (464)..(464): a, c, t, g, unknown or other
  modified_base (524)..(524): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaggtgtccaatgtgaggtgcaactggtggagtcgtgggggagcttggtacagccaggcccggtccctgacactctcctgcacagcttccggactcaccttggtgagcatgctatcgaccgtgggtcccgccgaggcctccgaggggaagggtctgggagtggcgtttggggtcagttagaagcgaacgcctagtgggtgggacaaaacgacaatacgccgcgtctagtaaaagggcagattcagcctntcaagagatgattaccaaaagcaatcgacctatcctgcacntgagacagcctagagaagaacgaggacgcagccgtgttagttcttgttcttattaacttntgttagtaagttgttaag

SEQ ID NO: 425742 - DNA, 791 bp, Homo sapiens
  misc_feature: GZ8MTXP01BNHEX.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtcgtaggaacacaagaactcgagactactccgtacggttcggggcccggggacgtacggtacggacgggtactaagttacgtaactaaattttagttacgtccgttaggttaacaaccaaacgaaacggaaaccggaaggggacgtacgtttaccgaacgtccttacgtagtactcttagtcgtcgtccgacccttaccgtaaccgttacccaccgtacgggacccgggtaccctacgttcccggttacggttcggacgggtccggtacgtagggtaacgtacgtcggggtaacggaactaggttaccgtttaccaccttcctaacctaacttacgacgaacgccgaccgcgttacgacgacggggtcgtaaaggtaacgttcgtttagtaaccgtaaactttaaactttaacgttaacgttaaccggtaaaaacttaaaagttaacttaaaaccttcccggttccccgttaaccccctttagttaaacccggtttaacggggtttaccccgggggaaacggggttaaccgggtaaaaccgggtagggggtaacccgtaaaaggtaaccttaaaccgggtaaaaaccggttggttaaccgggg

SEQ ID NO: 425743 - DNA, 534 bp, Homo sapiens
  misc_feature: GZ8MTXP01ASJ1D.25.4.A04.1.454.CMB.2.raw
  modified_base (510)..(510): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgacctgggtccgcaggctccgagggaggtctggagtggcttgggttcagttagaagcgaagcctagtgggtggggacaacacaaataccgccgcgtctagtaaaaggcaggattcagcctctacaagagatagattaccaaagcatcgctatctgcacatgagcagcctgaagaagcggaaggaactcgaggtccgttagtaacttacttgtttcttattaactntgagtagttagttgttaatttaac

SEQ ID NO: 425744 - DNA, 536 bp, Homo sapiens
  misc_feature: GZ8MTXP01B4AMI.25.4.A04.1.454.CMB.2.raw
  modified_base (456)..(456): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggcccggtccctgacactctcctgcacagcttccggactcacctttggtgagcatgctatgacctgggtccgccaggctccgagggagggtctggagtggcttgggttcattagagcgaagcctagtgggtggggcaacgacaaataccgccgcgtctagtaaaaggcaggattcagcctctcaagagatagattaccaaagcatcgactatcgtgcacatgagcagccngagagcgaggaactcgagtccgttgtactttacttcgtttcttacttaactctgaggtagttaggttggtttaatttaac

SEQ ID NO: 425745 - DNA, 482 bp, Homo sapiens
  misc_feature: GZ8MTXP01C2HF1.25.4.A04.1.454.CMB.2.raw
  modified_base (193)..(193): a, c, t, g, unknown or other
  modified_base (268)..(268): a, c, t, g, unknown or other
  modified_base (328)..(328): a, c, t, g, unknown or other
  modified_base (376)..(376): a, c, t, g, unknown or other
  modified_base (378)..(378): a, c, t, g, unknown or other
  modified_base (380)..(380): a, c, t, g, unknown or other
  modified_base (466)..(466): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctcatcctccctgtctgcatctgttgganacagaatcagcatcacttgccgggcagtcagggcattagcaatattagcctggtaatcaaacagaaacagggaanagttccaagctcctgatctatgctgcctcacgttacacctcgagggtcccatctcgttcngcgcagtgaatcgtgggacagtagttcactctcactaatcagcagccncncngacgtagagtatagtatatactatatataataaataataataactcttcctcttcgtacgtcggacggacggacgaaggagaaganacaacgtaacgttgtg

SEQ ID NO: 425746 - DNA, 507 bp, Homo sapiens
  misc_feature: GZ8MTXP01AKRF6.25.4.A04.1.454.CMB.2.raw
  modified_base (238)..(238): a, c, t, g, unknown or other
  modified_base (331)..(331): a, c, t, g, unknown or other
  modified_base (400)..(400): a, c, t, g, unknown or other
  modified_base (489)..(489): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcatagctaatnttagctgtatacaaacagaaaccgaggagacgttacctaagctcctgatctatgctgcctcacgttacacctcgagggtcccatctcggttcngcggcagtgaatcgtagggacagtacgttcactctacactatcagcacgcctgactagccgtagaagtntagttagacctaattattactagtaaacgtaaatataataactccgttccctcttcgtacgttcggacggaggaccgaaggtgaacganacgaacgtgttgtaacgg

SEQ ID NO: 425747 - DNA, 486 bp, Homo sapiens
  misc_feature: GZ8MTXP01B25UT.25.4.A04.1.454.CMB.2.raw
  modified_base (267)..(267): a, c, t, g, unknown or other
  modified_base (330)..(330): a, c, t, g, unknown or other
  modified_base (416)..(416): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatattagcctggtatcaacagaaaccaggganagttcctaagctcctgatctatgctgcctcacgttacacctcgacggggtcccatctcgttcngcgcagtgaatcgtgggacagtacgtcactctcactatcagcagcctgcagcctagagatgtgctaattatactgtaacaaagtanaataactcgttccctgttcctacgtttcggcggttacggaccaaggtgaagatcaaacgtaattgaacgg

SEQ ID NO: 425748 - DNA, 661 bp, Homo sapiens
  misc_feature: GZ8MTXP01EHSTK.25.4.A04.1.454.CMB.2.raw
  modified_base (281)..(281): a, c, t, g, unknown or other
  modified_base (304)..(304): a, c, t, g, unknown or other
tcagactgtacagtcacgaccggtgctcgatttagagtagtgatcaggggggctctggggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtggggggagcttggtacagccaggcccggtcctgacactctcctgcacagccttccggactcacctttggngagcatgctatgacctgggtccncaggctccgaggggaggtctggagtggcgtttgggtcagttagagcgaagccctagtgggtgggacaacaacaatcgccgcgtactaggtaaaaggcagtacttcgacgtcctctacgaaagagtaattaggtaaacttaacccgaaaaagtcctaaacttccgtacccttaagttccttacggacctaaccaagtcggaacgccgtaaacggcccgttaagggaaggaaacggcgggaaacgggtccttacggaacggttcccggttaggtttaaacttttaccgtttggttttacctttaatttaacccttcgttaggtaacggttaaggtttaacgggttttaaggtttttaaa

SEQ ID NO: 425749 - DNA, 580 bp, Homo sapiens
  misc_feature: GZ8MTXP01C2SK4.25.4.A04.1.454.CMB.2.raw
  modified_base (195)..(195): a, c, t, g, unknown or other
  modified_base (222)..(222): a, c, t, g, unknown or other
  modified_base (321)..(321): a, c, t, g, unknown or other
  modified_base (352)..(352): a, c, t, g, unknown or other
  modified_base (409)..(409): a, c, t, g, unknown or other
  modified_base (545)..(545): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacgttggccgggngagtcgagggcattagactaattattagctaggtatacaaacagaaaccagggatacgttacctaagctccgtgatctattgactcgcctcacgttacnccgtccgacggggtcccatccgtacggttcncgcggactaggtgaactcgtagggacagtagttccactctacactatcagccagccnggacacgtccgtagaagtattcggttactaacttaactttatttaactaggtaaactaaaagttactaaactaaccttccgccccttacttaccgttacggtttacgggcgggttaaacggggaccttaagggggngtaacgaagttaccgaaacgtaacgttgggtaacg

SEQ ID NO: 425750 - DNA, 796 bp, Homo sapiens
  misc_feature: GZ8MTXP01B1QDP.25.4.A04.1.454.CMB.2.raw
  modified_base (219)..(219): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtggagacagaatcagcatcacgtggccgggngagtcgagggcaagttagactaattagtttacgccgttaggtaactaccgaaaacgaacggaaaaccgagggggtaaacgtacgtttaccccgtaaagtcccgttacccgtaggtaaactttccgtaagttcgtccgttccggtacccccttaacccgaaccggttttaacccgaaccccgttcccgggtaaacggggggttccccctaagtttcccgttaacccggggttacaacgggccgggtaaccagggtacgtaaacgtcggtacggggaactacggtagttaccctactcctacctaacttaactacgaacggcctaacgtccccgtgacgtacggtaccctaaggtaaacgtagttacggtttacgtaaccgttaaaccttttaattaaaccgttacggttaaaacctaaaaaggtttaacttaaaccgttaaccgtacccggttccccctttaccgttacgttaaccccgggtttcggggaaccggggaacggggttaaaccccggaaagggggttcgggaaacgttaccgaaaccgttaaaaccggttaacggttaacgggtaaccgg

SEQ ID NO: 425751 - DNA, 513 bp, Homo sapiens
  misc_feature: GZ8MTXP01DVF1H.25.4.A04.1.454.CMB.2.raw
  modified_base (193)..(193): a, c, t, g, unknown or other
  modified_base (268)..(268): a, c, t, g, unknown or other
  modified_base (328)..(328): a, c, t, g, unknown or other
  modified_base (493)..(493): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttganacagaatcagcatcacttgccgggcagtcgagggcattagcaattattagcctggtatcaaacagaaaccagganagtctaagctcctgatctatgctgcctcacgttacacctcgagggtcccatctcggttcnggcgacagtagaatcgtgggacagtagttcactctacactatcagcacgctcgacgagaccgtagtaagtagttagttgtactaacttattaactagtactaaataataataactcttccctaccttcgtacgttacggttacggcggaccgaaggtagaagtanacgaacgtaacgttgtaacg

SEQ ID NO: 425752 - DNA, 511 bp, Homo sapiens
  misc_feature: GZ8MTXP01C6ZJQ.25.4.A04.1.454.CMB.2.raw
  modified_base (270)..(270): a, c, t, g, unknown or other
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttgccgggcagtcgagggcattagactaatattagcctggtatcaaacagaaacagganagttcctaagctctgatctatgctcgcctcctacgttacacctcgacgggtccatctcgttcngcgcagtgaatcgtagggacagtacgttcactctacactatacagcagcctgacacgccgtagaagtatagttacactaattataactagtaataaatataataacctcgcccttcttcgtacgttcgggacggttacggacgtaagggtagaagtacacaaacggtaagttgtaacg

SEQ ID NO: 425753 - DNA, 672 bp, Homo sapiens
  misc_feature: GZ8MTXP01BXOPH.25.4.A04.1.454.CMB.2.raw
  modified_base (286)..(286): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccgaggcccggtcctgacactctcctgcacagtccttccggactctacctttggngagcatgctatcgacccgtgggtccccgccgaggcctaccggagggggtaacgggtcgtggggaggtgggtcgtttggggttacaagttaggaagcgaaacgtcctaggtgggtacggggacaaaacgacaacgtcccggccggcgttacgtaaggtaaaacggggctaagggtacttaccgacggtcctacgtacgaaaggaagtatacggtaaacttaacccgaaaaagtcaactccgtacccgttaatctcgacaacgagtacggagacgacgcccgtaggaacggaacggcggtaacgggacctcggacggtaccgttagtttacgtttacttggtttaaccttattaaccgttgtagttacggttaagtttaaggtttaag

SEQ ID NO: 425754 - DNA, 660 bp, Homo sapiens
  misc_feature: GZ8MTXP01BTPWO.25.4.A04.1.454.CMB.2.raw
  modified_base (172)..(172): a, c, t, g, unknown or other
  modified_base (272)..(272): a, c, t, g, unknown or other
tcagactgtacagtcacgaccggtgctcgatttagagtagtgatcaggggctgggagaggagccccagccgtgagattcccaggagtctccacttggtgatcagcactgaaaacagaccaccaaccatggagtttgggcttaactgtcttttccttgttgctgtttaaaggngtccaatgtgaggtgcaactggtggagtcgtgggggagcttggtacagccaggccggtcctgacactctcctgcacagcttccggactcaccttttgggngagcatgctagtcgaccgtcgggtccgccgaggcctacggaggggtacggtcgtgggtagtcggtcgtttgggttacaagttaaggaacgacgaacgtccgtaggtcggggcgggacaaacgacgtaacgtaacccggcccgtcgtacgtaaaggtaaacggctagtactcgacgtcctacacgaagagtatacgtaacttaaccgaaagctactccgtacttactcgtacggacaacgtagtacgacgtccgacgtaccgtaaggaacggaacggcgtaacggtaccgtaacgtacggttccgttagtttacgtttacgttcgtttactttacgttacgttaagtaggtaagttaggttagtttacggtttaactttaacgtttaac

SEQ ID NO: 425755 - DNA, 565 bp, Homo sapiens
  misc_feature: GZ8MTXP01BLGPZ.25.4.A04.1.454.CMB.2.raw
  modified_base (194)..(194): a, c, t, g, unknown or other
  modified_base (221)..(221): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttcgccgggngagtcgagggcattagctaatattagcctggtatacaacaagaaaccaggagagttcctaagctcctgatctatgctgccctcacgttacacctccgacggggtccccattccgtaccggttcaacggcggcaggtgaacttccggtaggggacaggtattcaactctcactatcagcagcctgacacgctagaagattgttacgactaaactttattaactagtaaacaaattactaatctccttcccctacttaccgttacggtttccgggacgggttaaccgggaccgtaaggggttacgggaacgtaacgttacgaaaaaccgggtcgttaagggtccgg

SEQ ID NO: 425756 - DNA, 628 bp, Homo sapiens
  misc_feature: GZ8MTXP01AI02P.25.4.A04.1.454.CMB.2.raw
  modified_base (464)..(464): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttctttttccttgttgcttagttttaaaaggtgtccaatgtgaggtgcaacgtggtggagtcgtgggggagcttggtacagccaggccggtcctgacactctcctgcacagccttcccggactctacctttggtgagcatgctatcgaccgtgggtccgccgaggcctccgaggggaggtctgggagtggcgtttgggttcagttagaagcgaagcctagtgggtgggacaaacacaaataccggccgcgtacgtagtaaaaggcagactttacgacgtccctacgtacaagagtaatagtaacttaaccgaaaaacnctacgtccgtactactcgtacgacaacagtagacgcgacgaccgtaggaaggaacggacggaacgtaaccgtcgacggtaccgttagttaactttcgtttcgtttactttacgttaacttacgtaaggtaaggttaggtttacgtttaagttttaactttaacg

SEQ ID NO: 425757 - DNA, 616 bp, Homo sapiens
  misc_feature: GZ8MTXP01DGL3Q.25.4.A04.1.454.CMB.2.raw
  modified_base (196)..(196): a, c, t, g, unknown or other
  modified_base (224)..(224): a, c, t, g, unknown or other
  modified_base (362)..(362): a, c, t, g, unknown or other
  modified_base (426)..(426): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcattctgttgganacagaatcagcatcacgttggcccgggngagtcgagggcattagactaattattagccttgtaatacaaacaaggaaaccgagggaatacgtttaccaagctactagactctatcgctcgcctaccacgttacacccgtcgacgggtcccagttccgtacgggtcncggcgactaaggttagaacttcggacgggactaggtacttacaccttctacaactacgtcgacncgacgcgtcgacgacgacgtagtaagtagttacgttacgtaacgttaacttaacttaacttaacgttaaactaaagttaaacttaacttaacttaccgttcccttaccgttaccgttaccggttacgggttacgggacgggaacggtaaggtaggtaacgtaacgtaacgttaacgtaacgttaacgtcg

SEQ ID NO: 425758 - DNA, 551 bp, Homo sapiens
  misc_feature: GZ8MTXP01DX67U.25.4.A04.1.454.CMB.2.raw
  modified_base (263)..(263): a, c, t, g, unknown or other
  modified_base (372)..(372): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcaggcattagcaatattagctggtatcaacagaaacagganagttccaagctacctgatctatgctgcctcacgttacacctcgagggtcccatctacggttcaagcgctagtgaactcgtaggggacagagttcaactctacattaacncacgacacgcctcgacgacgacggtacgtaagtagttagttacgtactaacttaacttaacttaacgtaaactaaataaactaactaactaccgttaccctaccttacgtacgttacgggttacgggacgggaacggtaagggtaggtaagaacgtacgaacgtaacgttaacgtaacg

SEQ ID NO: 425759 - DNA, 531 bp, Homo sapiens
  misc_feature: GZ8MTXP01CNI13.25.4.A04.1.454.CMB.2.raw
  modified_base (194)..(194): a, c, t, g, unknown or other
  modified_base (220)..(220): a, c, t, g, unknown or other
tcagactgtacagtcacgaccggtgctcgatttagagtagtgatcagggggcagaagtccctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggnagtcagggcattagctaattattagcctggtatcaacagaaaccaggagagttccaagctcctgatctatgctgcctcacgttacactccgacgggtccagtctcggttcagcggcagtgaatcgtagggacagtagttcactctacactatcacgcacgcctgccagccgtagggaagtattgtacgtactaacctttattactacgtaataaaagttataactctcgtaccccttcttacgaccgtttacgggcgggacgggaccgagggtaaggacgaacttacgaacgttacgttgttcggtaaccg

SEQ ID NO: 425760 - DNA, 502 bp, Homo sapiens
  misc_feature: GZ8MTXP01AGPKD.25.4.A04.1.454.CMB.2.raw
  modified_base (265)..(265): a, c, t, g, unknown or other
  modified_base (329)..(329): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaatattagctggtatcaacagaaaccagganagttcctaagctcctgatctatgctgcctccacgttacacctcgaggggtcccatctcggttcngcggcagtgaatcgtgggacagagttcactctcactatcagcagcctgcagccgtgaagtatgttgctaacttattactgtactaaaagtataataactcgcccctcttcgtacgttcgggacgggttacggaccgtaagggtcgaagactacgaaacgtaacgttgtaacgg

SEQ ID NO: 425761 - DNA, 688 bp, Homo sapiens
  misc_feature: GZ8MTXP01DXHNH.25.4.A04.1.454.CMB.2.raw
  modified_base (193)..(193): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttganacagaatcagcatcacttggccgggcagtcagggcattagctaattattagccttaggtaatacaaacaacggaaaaccgagggaacgtacgtttaccctaaagccttacctagaacttccttaagtcgccttcgtccccttaccgtaacggtttaaccacccgtaccggtaacgggggttccccctagttcccggttaacccgggtttaccaaggggccgggactaaagggttacgaaacgttccggtagggggacctaagggtacttaccactctacgtaactaatccaaggccacgtccgtcgacgacgtacggtaagtaagtagttacgttacgttaacttaacgttaacttaacttaacgtaaactaaaacgttaaacttaacttaaccttaccgttcccttaccgttaccgttaccggttacgggttacgggttacgggaacggtaacgggtaaggtaacgtaacgtaacgttaacgtaacgttcgtcg

SEQ ID NO: 425762 - DNA, 517 bp, Homo sapiens
  misc_feature: GZ8MTXP01C1ZQV.25.4.A04.1.454.CMB.2.raw
  modified_base (223)..(223): a, c, t, g, unknown or other
  modified_base (273)..(273): a, c, t, g, unknown or other
  modified_base (278)..(278): a, c, t, g, unknown or other
  modified_base (342)..(342): a, c, t, g, unknown or other
  modified_base (415)..(415): a, c, t, g, unknown or other
tcagactgtacagtcacgaccggtgctcgatttagagtagtgatcaggggacagaagtctctctcagtcaggacacagcatggacatgagggtccctgctcagctcctgggactcctgctgctctggctcccagataccagatgtgacgtccagatgacccagtcctccatccctccctgtctgcatctgttggagacagaatcagcatcacgttggccgggngagtcgagggcattagctaattattagcctaggtatacaaacagaaaccnggganagttccaagctctgatctatgctgccctacacgttacacctcgacgggtcccatctcgggttcnggtcgctagtgaactcgtaggggacaggtattcactctcaactatcagcagcctgacacgccgtagaaagttnttgtactacttaattatactataaataaagtactactctcttcctgttcgtacgtcgggacggaggacgtaaggtagaacgtacgtacgaacgtcgttgtcg

SEQ ID NO: 425763 - DNA, 504 bp, Homo sapiens
  misc_feature: GZ8MTXP01A5VCI.25.4.A04.1.454.CMB.2.raw
  modified_base (219)..(219): a, c, t, g, unknown or other
  modified_base (330)..(330): a, c, t, g, unknown or other
  modified_base (484)..(484): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaatattagcctggtatcaaacagaaaccaggagagttcctaagctcctgatctatgctgcctcacgttacacctcacggggtcccatctcgttcngcggcagtgaatcgtagggacagtagttcactctacactatcagcagccctgcagccgtagaagtatgttgactaattacttactgtaacaaaagtataaatctacgccctcttcgtacgttcgggacggttacgggaccgaagggtgaacganacgaaacgtaacgttggtcg

SEQ ID NO: 425764 - DNA, 672 bp, Homo sapiens
  misc_feature: GZ8MTXP01AYARE.25.4.A04.1.454.CMB.2.raw
  modified_base (221)..(221): a, c, t, g, unknown or other
  modified_base (449)..(449): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggngagtcagggcattagctaattattagccttggtatacaaacagaaaccagggagagttaccaagctcctgatctatcgctcgcctaccacgttacacctcgacggggtcccattcgtcggttcaaggcgggcaggtagaacgttcggtaggggtaaccaggtacgtttccaacttcctacaaccttaagtccaaggcacggccctaggacacggccctaggaaacgtntttacgggttactaactaaacctttaagtttaaccttaggttaaacctaaaaagtttaacttaaaacttaacccgttaccgttaccccctttacgttacccggtttaaaccggttttacgggggacccggggttaaacgggaaaccccggggtaaaggggttacccgggggaaaatttaacggtaaccggaaaaaacccggttaacggtttgggtaacccggg

SEQ ID NO: 425765 - DNA, 534 bp, Homo sapiens
  misc_feature: GZ8MTXP01APA8X.25.4.A04.1.454.CMB.2.raw
  modified_base (219)..(219): a, c, t, g, unknown or other
  modified_base (268)..(268): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaatattagcctggtatcaacagaaaccagganacgttacctaagctctgatctatgctgcctctacgttacacctcgacggggtcccagtctcggttcaacggcggctagtagaatcggagggacagtacgttcactctacattactcaagcagcctgacacgccgtagaagtntaggttacacttaacttattactagtaacaaagttactaatctccgttccctcttcgtaccggtttacggacgggacgggttaccgaagggtcgggaatacgtacgaaacgtcgttggtaacgg

SEQ ID NO: 425766 - DNA, 532 bp, Homo sapiens
  misc_feature: GZ8MTXP01AO6IS.25.4.A04.1.454.CMB.2.raw
  modified_base (221)..(221): a, c, t, g, unknown or other
  modified_base (274)..(274): a, c, t, g, unknown or other
  modified_base (426)..(426): a, c, t, g, unknown or other
  modified_base (507)..(507): a, c, t, g, unknown or other
  modified_base (513)..(513): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacttggccgggngagtcgagggcattagctaatattagcctggtatacaaacagaaaccaggganagttacctaagctcctgatctatgctcgcctccacgttacacccgtcgagggtcccatcgtacgttcaaggcgcgagtgaatcggtagggactagtcgttacactctcaactatcagacacgccctagcctagcctaggaagtatggttacnctaaactttatacgtataacaaagttataactaacgtccttacccttgttccgtacgttcggaggttacgaccgtaagggngaatanacgaacgtaagcggtaacg

SEQ ID NO: 425767 - DNA, 734 bp, Homo sapiens
  misc_feature: GZ8MTXP01AYT2C.25.4.A04.1.454.CMB.2.raw
  modified_base (280)..(280): a, c, t, g, unknown or other
tcagactgtacagtcacgaccggtgctcgatttagagtagtgatcagggggctctgggagaggagcccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccaggcccggtccctgacactctcctgcacagccttccggactcacctttggngagcatgctatcgaccgtgggtcccgcccaggcctaccggaagggggtaacgggtcgtggggtaggtcgggtcgtttgggggttacagtttaaggaacgtcggaaagtcccccgttaaggtgggggtacgggggaccaaacggaaacaaacgtaaccggacccggtacggttacgtaacgggtaaaaagggccgtaaaggtactttccgaacgtccccttacgtacgaaaggaacggtaagttacggtaaactttaaaccccgaaaaaagtcctaacgttacccggtacccttaacttcgttacggaccgaaactaagttggaacgccgaacggtccctaggaaacggaacggcggaaacgggaccttcgaacggttccgggttattaacgtttaactttcggtttactttaacttaccttcgtggaaggttagtttaaggttaaggtttttaa

SEQ ID NO: 425768 - DNA, 519 bp, Homo sapiens
  misc_feature: GZ8MTXP01DTXXF.25.4.A04.1.454.CMB.2.raw
  modified_base (219)..(219): a, c, t, g, unknown or other
  modified_base (263)..(263): a, c, t, g, unknown or other
  modified_base (322)..(322): a, c, t, g, unknown or other
  modified_base (372)..(372): a, c, t, g, unknown or other
  modified_base (374)..(374): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcaggcatagcaatattagcctgtatcaacagaaaccagganagttcaagctctgatctatgctgcctcacgttacacctcgagggtcccatctcggttcngcgcagtgaatcgtagggacagattcaactctacactaatcaagcacgcncncacgacgtagtaagtagtagtacgtactaacttaacttaactacgtaactaaagtaaataataactacgttccctaccttaccgtacgttacggttacggacggacggtaaggtaggaagaacgtaacgaacgtaacgttaagtg

SEQ ID NO: 425769 - DNA, 555 bp, Homo sapiens
  misc_feature: GZ8MTXP01D4PN6.25.4.A04.1.454.CMB.2.raw
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacagccaggcccggtccctgaccactctcctgcacagccttccggactcacctttggtgagcatgctatgacctggtccgcaggctccgaggggaggtctggagtggcgtttgggtcagttagaagcgaagtcccctagtgggtgggcaacaacaatcgccgcgtactagtaaaaggcagattcagcctctacaagagatagacttaccaaaagcaatcgcctatctgacacatgagcaacgccgtagagaacgcggaaggtccttcgacgttccgtagttacttacgttgtttacctttaattactgtgagttagttaagttggttttaac

SEQ ID NO: 425770 - DNA, 660 bp, Homo sapiens
  misc_feature: GZ8MTXP01EEF95.25.4.A04.1.454.CMB.2.raw
  modified_base (270)..(270): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggagcttggtacagccaggccgtcctgacactctcctgcacagcttccggactcacctttggngagcatgctatcgaccgtgggtcccgccaggcctaccgaggggtaagggttctgggagtgggtacgtttgggggttactagttaggaacgcggtaaagccgttagtggggtacggggacaaacgacgaaaacttaccggcccgtacgtacgtaagggtaaaacggcaggtacttacacgtcctctacaagagtatagtaacttaccgaaaagctaactccgaccttaacgtctagccaactagtcgaacgccgacggtaccgaggaaccggaaaggccggaaggaaccgttacgacggtcccgttaggttaactttaaccgttagttttccctttaatttaaccgttgtaaggtaggtaagtttaggtttaagggttttaattttaaacg

SEQ ID NO: 425771 - DNA, 737 bp, Homo sapiens
  misc_feature: GZ8MTXP01AHYG4.25.4.A04.1.454.CMB.2.raw
  modified_base (222)..(222): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacgttggccgggngagtcgagggctagttagactaattatttagccttaggtaactacaaacgaacggaaaaccgaggggtaacgtacgtttaccctaaaggtcccttaccgtaggtaacttccgtaattccggcctttaccggacccccttacccgtaaacggtttaaccaccccgttccgggaacgggggttccccctaagttcccgttaacccggggttcaacggggtccggaccgtaaggttacggtaaacgttcgggtagggggaacctaagggttacgtttacccaccgttacctaccgtaacgttaaactcgaaacggcctaaccggcctagacgaaccgtccgggtaaagtaaacgtgttacggttacgaacctttaaacgtttatttaaacgtacgttaaaaccggtaaaatttacgttaaactccctacggttccccttacgttaccgttacggttcggggacggttacggttaaccgaagggttgaacgtaactaaccgaagtaacgttggtaaccg

SEQ ID NO: 425772 - DNA, 556 bp, Homo sapiens
  misc_feature: GZ8MTXP01DG5XX.25.4.A04.1.454.CMB.2.raw
  modified_base (378)..(378): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtcagatgacccagtctccatcctccctgtctgcatctgttggagacagaatcaagcatcacgttgccgggacagtcagggcattagacaattattagcctggtaatacaaacagaaaccagggaagagttcctaagctcctgatctatgctgcctcacgttacacctcgagggtcccatctcggttcaagcgcagtagaatcgtgggacagtattcactctcactaancagcacgcgcgacacgacggtagtaagtagttagttacgtacttaacttaacttaaacttaacgtaaactaaaagtaaacttaaactaactaccgttccctaccttacgtacgttacgggttacgggacgggaacggaagggtaaggaagtaacgtaacgaaacgtaacgttaacgtg

SEQ ID NO: 425773 - DNA, 648 bp, Homo sapiens
  misc_feature: GZ8MTXP01DJAIU.25.4.A04.1.454.CMB.2.raw
  modified_base (222)..(222): a, c, t, g, unknown or other
  modified_base (504)..(504): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgctatctgttggagacagaatcagctatcacgttggccgggngagtcgagggtcattagactaattattacgccttaggtaactaccaaacgaacggaaaaccgaggggtaaacgtacggtttaccctaaaggcccttacccgttagtaacttcgttaacgttcggtcccttaccggtaccccttacccgtaaacggtttaaccccaccgttaccgggtaaccgggggtcccctaagttccgttcccgggttaaacgggtcggctaaaggtcgaaactcggtaaggggaccagttattacactctactactatcagcacgcgancacgcgtagtatagttgtatactaacttattaacgtataataaagtactaactcttccacccgttccttacgtacggttcgggaacgggacggttaaccggttaagggagtaacgacgtaacgttaaaacgtcgttccggttgg

SEQ ID NO: 425774 - DNA, 783 bp, Homo sapiens
  misc_feature: GZ8MTXP01DFRL4.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtctccatccctccctgtctgcattctgttaggagacagaatcagcatcacgttggccgggngagtcgagggcattagactaattatttagcctaggtaactacaaacgaagaaaccgaggggaactacgtttacctaaggccttacctaggtaacttcgttaagttcgccttcgacccttacccgaaggtttacccacccgttaccggacggggttcccctaagttcccgtcgggttcaacgggcgggtaccgtaggttaggaaacttccggagggggtaacctagggttacttaccaccttaccttacaaacccggttaaagttccaacggtaccaaccgggacccttggacccgtaacggacccggtttaaaggggaaactttaaagtttcgggttaactaaccgtttaaaccgttttaaattttaaacccggttaagtaaaccgttaaaaaagtttaaccgtttaaaactttaaccccttaaacccggttcccccttttaacgttaccggtttacccgggttttacgggggaaccggggttaacgggttaaaccccggttaaaggggttagggaaacgtaacgttaaaccggaaaaaccgttcggttggttaaccggg

SEQ ID NO: 425775 - DNA, 592 bp, Homo sapiens
  misc_feature: GZ8MTXP01D6L0W.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgtttaaagtgtcaatgtgaggtgcaactggtggagtcgtgggggagcttggtacagccaggccggtccctgacactctcctgcacagcttcccggactctacctttggtgagcatgctatgaccgtggtccgccaggctccgagggaggtctggagtggcttggggttcagttagaagcgaaagcctagtgggtggggacaacacaaataccgccgcgtctaggtaaaaggcaggattcagtcctacgtacaagagtaatagaactttaccaaaaagcaactcgtaccttaatctagaccaaccagtagaagccgaaggccctaggaaggaacggaccggtaagggaacctcgaaggtcccggtttagtaactttacgttgtttccttatttaactcgtaaggtagtagttaggttggttttaatttaac

SEQ ID NO: 425776 - DNA, 540 bp, Homo sapiens
  misc_feature: GZ8MTXP01EF9CZ.25.4.A04.1.454.CMB.2.raw
  modified_base (194)..(194): a, c, t, g, unknown or other
  modified_base (330)..(330): a, c, t, g, unknown or other
  modified_base (337)..(337): a, c, t, g, unknown or other
  modified_base (400)..(400): a, c, t, g, unknown or other
  modified_base (415)..(415): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttgccgggcgagtcgagggcattaccaattattagcctggtatcaacacaaaccaggaaatccctaagctcctgtatctattctgcatccacttgcagtcccagggtccatctcgcttnggcgcgngtgatcgaggggacagtatttcacgtctaccacactcaccggctgcagcctggacgatcgttnactaacttatactanaactaaactatacactcgtcgtaccccgttaacgtggttttacggccgtaacggggttacccacgttacgggttaacggaacccgttaacgaaaacggtaaccgttaggttcggcggttaacccg

SEQ ID NO: 425777 - DNA, 582 bp, Homo sapiens
  misc_feature: GZ8MTXP01B80JN.25.4.A04.1.454.CMB.2.raw
  modified_base (486)..(486): a, c, t, g, unknown or other
  modified_base (539)..(539): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttctttttccttgttgcttagttttaaaaggtgtccaatgtgaggtgcaactggtggagtcgtgggggagcttggtacagccaggcccggtcctgacactctcctgcacagccttccggactctaccgtttggtgagcatgctatcgaccgtcgggtcccgccgaggcctccgaggggaacggggtctgggagtggtcgtttggggtcagttagaagcgaagtccctagtgggtggggacaacaaacaatccgccgtacgtactaggtaaaagcagacttcacgcctctacaagagatagtacttaccaaattcaatcgacctatctgacacatgancaacgcctaggagaacgcggaacgacttcgacgttccgtagttacttacgttnttacttaattacttcgtagtaggttagttaagttaaggtttaa

SEQ ID NO: 425778 - DNA, 554 bp, Homo sapiens
  misc_feature: GZ8MTXP01BEC24.25.4.A04.1.454.CMB.2.raw
  modified_base (338)..(338): a, c, t, g, unknown or other
  modified_base (352)..(352): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagctaattattagccttggtatcaaacagaaaccagggagagttccaagctcctgatctatgctgcctccacgttacacctcgacgggtcccatctacggttcngcgcagtgaatcgngggacagagttcactctcactatcagcagcctgacagccgtagaagtacttgttacgtactaactttattaacctagtaaactaaaagttactaagtaacctccgttccccttcttaccgttaccgtttcgggacggggttacgggaacccgtaagggttgggaacgtaacgtacgaaaacggtaaccgttgggtaaccggg

SEQ ID NO: 425779 - DNA, 509 bp, Homo sapiens
  misc_feature: GZ8MTXP01DP4KW.25.4.A04.1.454.CMB.2.raw
  modified_base (195)..(195): a, c, t, g, unknown or other
  modified_base (222)..(222): a, c, t, g, unknown or other
  modified_base (245)..(245): a, c, t, g, unknown or other
  modified_base (276)..(276): a, c, t, g, unknown or other
  modified_base (335)..(335): a, c, t, g, unknown or other
  modified_base (387)..(387): a, c, t, g, unknown or other
  modified_base (492)..(492): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcaagcatcacttggccgggnagtcgagggcattagactaattnttagcctggtaactcaaacagaaacaggganagttcctaagctctgatctatgctgcctcagttacactcgagggtcccatcgtcggttnggtcgcagtgaatcgtagggacagtattcactctcactaatcagcacgtccncacacgacggtagtaagtagtagtactactaacttaacttactagtaataaataataactaactcttcctcttacgtacgtcggacggacggacgaagagaaganacgaacgtaacgttgtg

SEQ ID NO: 425780 - DNA, 733 bp, Homo sapiens
  misc_feature: GZ8MTXP01EK38Q.25.4.A04.1.454.CMB.2.raw
  modified_base (198)..(198): a, c, t, g, unknown or other
  modified_base (265)..(265): a, c, t, g, unknown or other
  modified_base (283)..(283): a, c, t, g, unknown or other
tcagactgtacagtcacgaccggtgctcgatttagagtagtgatcagggggcagaagtctctctcagtcaggacacagcatggacatggagggtccctgctcagctcctgggactcctgctgctctggctcccagataccagatgtgacgtccagatcgacccagtcctccactcctccctgtctgcatctgttgganacagaatcagccatcacgttggccgggcgagtcgaggtcagttagctaaattattagccttaggtanacaaacgaacgaaaccgngggaacgtacgttaccctaaaggccttccgagtaacttctagtcgctcgtcccctacgtactacaccgtcgaacgggtccctagttcccgtcggttacaacggcgtaccgtaagtgtaaacgttccggaggggaactaggtacgtttccaacttcctacctaactttaggtaccaacggtcccgaccgtaccgtacgacgtaccgtaccgggtaacggtaagttaacgttacgttaacgttaaccgttaactttaaacgtttaacgttaaacgttaaacgttaaaacgttaaacttaaaccgttaaccgttacccgttaccccgttacccgttaccggttacccgggttaaccggggttaaccggggttaaccggggttaaccgggtaaacgggtaacggtaaacggtaaacgtaaacggttaaaccggtaaccggttaacgggtaacgg

SEQ ID NO: 425781 - DNA, 654 bp, Homo sapiens
  misc_feature: GZ8MTXP01BF40F.25.4.A04.1.454.CMB.2.raw
  modified_base (259)..(259): a, c, t, g, unknown or other
  modified_base (283)..(283): a, c, t, g, unknown or other
  modified_base (474)..(474): a, c, t, g, unknown or other
  modified_base (607)..(607): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacagccaggcccggtccctgaccactctcctgcacngccttccggactctaccgtttggngagcatgctatcgacccgtgggtccccgccgagggccgtacccggaagggggtaacgggttcgtggggaggttgggtacgttttgggggttacagtttaaggaaggcggaaagcccctaggtggggtggggacaaacgaaacaacgtccgccgtcgtactaggtaaaacggcaagtacttcagtcccttanacgaagagtaatagtaacttaaccgaaaagcaattccgacccttaagtctgaccaacagtcgacgacgtacgcgtaggaacggacggcggtaacggtacttacggtacggttcgttagttaactttacgtttntttactttaattacgtcgtagtagttaggtttaagtttaacgtttaa

SEQ ID NO: 425782 - DNA, 746 bp, Homo sapiens
  misc_feature: GZ8MTXP01DVZOE.25.4.A04.1.454.CMB.2.raw
  modified_base (194)..(194): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttggccgggcgagtcgagggctattagactaaattattagccttaggtaactacgaaacaaggaaaaccgaggggtaacgtaacggtttaccctaaaaggtccttacccgttaggtaaactttcttaacgttcgtccgtttcgacccctttaccgtaaaccggttttaaccaccccgttacccgggtaacgggggttacccccctaaagtttcccggtttaacccgggttacgaacggggcccggtacgtaaaggttacgaaacgtttccgggaggggtaaccaggtaacgtttccaacgttcctaactaaccttaatccgaaggccaacggccttacggacacgaccggtacggtaagtaagttagttacgtaactaaaccgtttaagtttaacttaacgttaaattaaaattaagtaacgtaacgtacggttacggtaccggttaggttacggttaccggttacccggacgggttaaccggaacgggtacgggtaacgtaactaaccgaaacgtaaccgttaaggtaaccggg

SEQ ID NO: 425783 - DNA, 552 bp, Homo sapiens
  misc_feature: GZ8MTXP01C4DAM.25.4.A04.1.454.CMB.2.raw
  modified_base (301)..(301): a, c, t, g, unknown or other
  modified_base (359)..(359): a, c, t, g, unknown or other
  modified_base (382)..(382): a, c, t, g, unknown or other
  modified_base (409)..(409): a, c, t, g, unknown or other
  modified_base (458)..(458): a, c, t, g, unknown or other
  modified_base (525)..(525): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactggtggagtcgtgggggaggcttggtacagccaggccggtccctgacactctcctgcacagcttccggactctaccgtttggtgagcattctatgacctgggtccncaggctccgaggggaggtctggagtggtctttgggtcagttagaagcgaagccctagnggtgggacaacaacaatcgccgngtactagtaaaggcagattcagtcctntacaagagatagaacttaccaaaagcactcgcctagtctgacacatgancagcctaggagaagcgaaggcttcgacgttccgttagtactttaccgttgtttaccttaatttaccngttgaggttagttaaggttgtttttaa

SEQ ID NO: 425784 - DNA, 564 bp, Homo sapiens
  misc_feature: GZ8MTXP01DDGHS.25.4.A04.1.454.CMB.2.raw
  modified_base (220)..(220): a, c, t, g, unknown or other
  modified_base (348)..(348): a, c, t, g, unknown or other
  modified_base (481)..(481): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcagggcattagctaattattagcctggtaatacaaacaagaaaccgagggaagtacgttacctaagctcctagatctatgctcgcctacacgttacacctcgacgggtcccatcgtcggttacnggcgacagtgaatcgtagggacagtagtcactctacactatcagtcagcctgccagccgtagaagtattggtactactaaactttattaacctagttaaacctaaaagtactaaataacctccgttccccttnttaccgttaccgtttcggggacggttaacgggaaccgtaaggggtagtaaggacctaacgaaaaccggtaacgttggtaacgg

SEQ ID NO: 425785 - DNA, 547 bp, Homo sapiens
  misc_feature: GZ8MTXP01C2JDP.25.4.A04.1.454.CMB.2.raw
  modified_base (395)..(395): a, c, t, g, unknown or other
  modified_base (473)..(473): a, c, t, g, unknown or other
  modified_base (487)..(487): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaactggtggagtcgtgggggagcttggtacagccaggccgtccctgacactctcctgcacacgccttccggactctaccgtttggtgagcatgctatcgacctgggcccgccaggcctccgaggggaaggtctgggagtggtcttgggtcagttagagcgaacgcctagtgggtagggacaaaacacaagtacgcccgngtactaggtaaaaggcaagattcacgcctctacaaagagatagactaccaaaagcaatccgacctatctgcacatgancagcctagagaagngtagactcgagtccgtgttactttacttgtttaacttattctgtgagtaagttgtttaag

SEQ ID NO: 425786 - DNA, 622 bp, Homo sapiens
  misc_feature: GZ8MTXP01B4ROI.25.4.A04.1.454.CMB.2.raw
  modified_base (220)..(220): a, c, t, g, unknown or other
  modified_base (474)..(474): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtctccatcctccctgtctgcatctgttggagacagaatcagcatcacgttggccgggngagtcgagggcattagactaattattagccttaggtaactacaaacaaggaaaaccaggggaagtacgttacctaaagccttaccgtagacttctaatggcctcgcccttaccgaacgttaccacccgttcggacggggtcccctaagtccgttacgggttcaacgggcggtactaggttaggaacttcggtaggggaacctagtacgttcactctacaactatcacgcgacgcctgacacgccgtagtaagtnttcggttactacttaatttaacttaactagtaaacgtaaaattacttaaactaacctccgttacccctacttaccgtaaccggtttcggggacgggttacggggaaccgtaagggtgaagtaacgtacgaaacgtaacgttggaacgg

SEQ ID NO: 425787 - DNA, 798 bp, Homo sapiens
  misc_feature: GZ8MTXP01ASRLV.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgctatcgtggtaggagacagaatcagcatcgtacgttcggccgggcgtagtcgagggctaagttagactaattagttacgccgttaggtaactaccaaacgaacggaaaccgtaggggtaagtaaccgtttaccctaagtcccttccgtagtacttactacgtcggtccttcgaccccttaccgtaaaccgttacctaccccggtaccggtaaccggggttcccctaacgtttcccggttaaccgggttacgaacgggtccggtacgtaacgggtacggtaaacgttccgggtaaggggaaacttacggttacgtttacccaaccttccgttaaccgtaccttaaacgtccgaacgtcccgtacggcccctgaccgtaccgttaccgggggtaagtaaggttacgtttcgggtaaaccttaaacctttaaacctttaaaggtttaaaccgtttagtaaaaaccgtttaaaagttaaccttaaacccgtaacccgttcccttcccccgttacgttacccgtttaacggggttacccggggaaccgggttaacggggttaaaccgtaaggggttacgaaacgttacgtaaaccggaaaccgggtgtttcgggaacg

SEQ ID NO: 425788 - DNA, 510 bp, Homo sapiens
  misc_feature: GZ8MTXP01BQEOH.25.4.A04.1.454.CMB.2.raw
  modified_base (220)..(220): a, c, t, g, unknown or other
  modified_base (272)..(272): a, c, t, g, unknown or other
  modified_base (286)..(286): a, c, t, g, unknown or other
  modified_base (332)..(332): a, c, t, g, unknown or other
  modified_base (373)..(373): a, c, t, g, unknown or other
  modified_base (405)..(405): a, c, t, g, unknown or other
  modified_base (429)..(429): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgaccccagtctccatcctccctgtctgcatctgttggagacagaatcagcatcacttgccgggnagtcagggcattagctaattattagcctggtaatcaaacagaaaccaggganagttccaagctccngatctatgctgcctcacgttcacctcaggggtcccatccgtcgttngcgcagtgaatcgtagggacaggtattcactctcaacttancagcacgcctggcacgccgtagaagtattgtnacctaattattactgtaacaaatntaataactcaccctcttacgtacgtttcgggacggttacgggaccgaagggtgaacgtacacgaaacgtaacgttgaacgg

SEQ ID NO: 425789 - DNA, 599 bp, Homo sapiens
  misc_feature: GZ8MTXP01DTKEG.25.4.A04.1.454.CMB.2.raw
  modified_base (225)..(225): a, c, t, g, unknown or other
  modified_base (361)..(361): a, c, t, g, unknown or other
  modified_base (592)..(592): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgaccccagtcctccactccctccctgtctgcatctgttggagacagaatcagcatcacgttggccgggngagtcgagggcattagactaattattagcctaggtaatacaaacgagaaacgagggaagtacgttacctaagctcctagattctatgctcgcctccacgttacacccgtcgtacgggtccctatccgtaccggttnaacggcggctaaggtcgaagtcgtaggggactagtacgttccactctactaactactcgaagccacgtcctaggaccacggtaccgtaggaagtattacggttacgaaccttaattttacttaaacgtacgttaaaataaaattactaactaacctccttccccttacttaccgttacggttcgggacggttacgggaacgtaagggtacggaagtacgacgaacgtaagnggtaacg

SEQ ID NO: 425790 - DNA, 584 bp, Homo sapiens
  misc_feature: GZ8MTXP01EL97R.25.4.A04.1.454.CMB.2.raw
  modified_base (174)..(174): a, c, t, g, unknown or other
  modified_base (219)..(219): a, c, t, g, unknown or other
  modified_base (272)..(272): a, c, t, g, unknown or other
  modified_base (311)..(311): a, c, t, g, unknown or other
  modified_base (337)..(337): a, c, t, g, unknown or other
  modified_base (356)..(356): a, c, t, g, unknown or other
  modified_base (390)..(390): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcccncctgtctgcatctgtggagacagaatcagcatcacttggccgggngagtcgagggcattagctaattattagcctgtatacaaacagaaaccaggganagttccaagctctagatcatgctcgcctacctcgttacncctcggacgggtcccagtcgtcgttncggtcgctgtagattcggnggacagtcgttcactctacactactcgacgtacncgtccgtcgacgaacgtccttaggaaaggttcttgggttactaacctaactttttaaacaccttaagtaaactaaattacttaaacggtaaccttccgttccccctagttaccgtacgggtttaccgggacgggttaacggggacccgttaaggtcggaacgtaaacgtacgaaaacggtccgttaaggtccgg

SEQ ID NO: 425791 - DNA, 535 bp, Homo sapiens
  misc_feature: GZ8MTXP01BRD1T.25.4.A04.1.454.CMB.2.raw
  modified_base (423)..(423): a, c, t, g, unknown or other
  modified_base (465)..(465): a, c, t, g, unknown or other
  modified_base (472)..(472): a, c, t, g, unknown or other
  modified_base (493)..(493): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttattgctgttttaaaggtgtccaatgtgaggtgcaactggtggagtcgtgggggaggcttgggtacagccaggcccggtccctgacactctcctgcacagccttccggactcacctttggtgagcatgctatgacctgggtcccgccaggcctccgagggggaacgggtcgtgggagtgggtcgtttggggttcagttagaagcgaagcctagtgggtgggcaaaacacaatacgccgcgtctagtaaaggcagattcagcctcncaagagatgattaccaaagcaatcgctatctcgcacgatgancacgtcngagagcgagactcgcgtcgtnttacttcttgtttcttattctgttagttagttaagttgttaa

SEQ ID NO: 425792 - DNA, 570 bp, Homo sapiens
  misc_feature: GZ8MTXP01BP8SW.25.4.A04.1.454.CMB.2.raw
  modified_base (195)..(195): a, c, t, g, unknown or other
  modified_base (276)..(276): a, c, t, g, unknown or other
  modified_base (342)..(342): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacgttggccgggcgagtcgagggcattagctaattattagcctggtatacaaacagaaaccaggganagttcctaagctcctgatctatgctcgccctacacgttacacctcgacgggtcccatctcggttcngcgcagtgaatcgtagggacagtacgttcactctacactactcgacgtcagccctgacgacgccgtagaacgtattggttacacctaactttattaactagtaactaaaagttataaactaacctcgccccttacgttccgtaccggtttacgggaccgggttacgggttaacccgtaaggggtcggaacgtaacgtacccgttaaaacggtaacgttaacggtccgg

SEQ ID NO: 425793 - DNA, 744 bp, Homo sapiens
  misc_feature: GZ8MTXP01BU6OF.25.4.A04.1.454.CMB.2.raw
  modified_base (275)..(275): a, c, t, g, unknown or other
tcagactgtacagtcacgaccggtgctcgatttagagtagtgatcagggggcagaagtctctctcagtcaggacacagcatggacatggagggtccctgctcagctcctgggactcctgctgctctggctcccagataccagatgtgacgtccagatcgacccagtcctccatccctcctgtctgcatctgttggagacagaatcagcatcacgttggccgggcgagtcgagggcattagctaattattagcctagtaatacaaacaagaaacgngggaatacgttacctaagcctaccgtagacttctagtcgtcctcgtacccctaccgtaaccgttaaccacccgttccgggtaacggggttccccctagttcccgttaccgggttacgaacgggccggtaccgtaagggtacgtaaacgtttccgggtaggggaaccctaagggttacgtttacccaaccgttccttactaaacgtttaaaccgtaccgaacgaccgtaccgtccgtagaccgtacgtacggttaaaggtaacgttacgttacggttaactaaccgtttaaacgtttaacgtttaaacgttaaacgttaaaacttaaaagttaacttaaaccgttaacccgttcccgttaccccgttacgttaccggttaaccgggttaccggggaacgggttaaccgggttaaacggtaaggggtacgtaaacgtaacgtaaaccggttaaacggttcgttcggtaacg

SEQ ID NO: 425794 - DNA, 798 bp, Homo sapiens
  misc_feature: GZ8MTXP01BJZ5C.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagtcttggtacagccgaggcccggtcctgacactctcctgcacagtccttccggactctaccgttggtcgagcatgctagtcgaccgtcgggtcccgccgaggcctaccggagggggtaagggtcgtaggggtaggtcgggtcgtttgggggttactaagtttaaggaaaggtccggtaaacgtcccgttaaggtcgggggtacgggggaacccaaaaaaccgaacgaaacgtacccgggcccggtacggttaccgttaaagggtaaaaacgggctaaaggtactttaccgaacggtcccttactaacgaaaggtaaagtaacgttagtaaactttaaacccgaaaaaacgctaaacttcccggtaaccctttaacgttccgttacggacctaaacctaacgtaggaacggaccgaaacggtccccgttaggggaaacgggaaacgggaaccgggtaaacggggaaccttaccggaaacggttcccggtttaggtttaacgttttaccgtttacggttttaacccttttaagtttaacccttcggttaggttaagggttaacggttttaaggttttaagg

SEQ ID NO: 425795 - DNA, 596 bp, Homo sapiens
  misc_feature: GZ8MTXP01AGWLC.25.4.A04.1.454.CMB.2.raw
  modified_base (194)..(194): a, c, t, g, unknown or other
  modified_base (221)..(221): a, c, t, g, unknown or other
  modified_base (367)..(367): a, c, t, g, unknown or other
  modified_base (372)..(372): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttggccgggngagtcagggcattagctaaattattacgcccggtatacaaacgaagaaaccgagggagtacgttaccgtaaagcctcctagacttcctatcgctcgccctcctacgtacacgtcccgacggggtccagtccgtcggttacaggcgnaggtnaacgtcgtgggacaggtacttacactctacactatcancacgcccttgacctagccgttagggaagtagttcgtacgaacttaaactttatacgtaagtaaactaaaagttacttaaacgtcctaaccgtccccttagtaccgttacggtttcggggaacgggttaacgggaccgttagggtaaggtaacaacgttaacgaaaccggttacgtggttcgtaacg

SEQ ID NO: 425796 - DNA, 522 bp, Homo sapiens
  misc_feature: GZ8MTXP01CAOZI.25.4.A04.1.454.CMB.2.raw
  modified_base (166)..(166): a, c, t, g, unknown or other
  modified_base (219)..(219): a, c, t, g, unknown or other
  modified_base (269)..(269): a, c, t, g, unknown or other
  modified_base (418)..(418): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcnccatcctccctgtctgcatctgttggagacagaatcagcatcacttgccgggnagtcagggcattagctaattattagcctggtatacaacagaaacaggganagttccaagctctgatctatgctgccctcacgttacaccgtcacggggtcccatcgtacggttcaaggcgtacaggtagacgtcgtaggggacagtagttcacgtctacactactcaagtcacgcctgcagcgtagaagtcttggttanctaacttatactagtacaaagttactaataacgtcttccctagttctacggtttcggacgggcgaaccgtaagggtcgaagtactacgaaacgtcgttggtcgg

SEQ ID NO: 425797 - DNA, 639 bp, Homo sapiens
  misc_feature: GZ8MTXP01A59UF.25.4.A04.1.454.CMB.2.raw
  modified_base (275)..(275): a, c, t, g, unknown or other
  modified_base (301)..(301): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccagggccggtccctgacactctcctgcacagcttccggactcacctttggngagcatgctatcgaccgtgggtcccncaggcctccgaggggacggtctggagtgggtcgtttgggttacagttaggagcgaagcctagtggggtgggacaaacacaaaacgtaccgcccgcgttacgtaagggtaaaacgggctaaggactttccgacgtccctactacaaaggagattaggtaacttacccgaaaagcctaactcccgaccttaatccgttagacctaactacgtggaacgccgacgacccgtaggaaacggaaacggccggaagggaaccttcgacgggtcccgttagttactttaacgttcgtttactttacttaactcgtaagagtagttagttaaggtttaattttaac

SEQ ID NO: 425798 - DNA, 622 bp, Homo sapiens
  misc_feature: GZ8MTXP01BMXXH.25.4.A04.1.454.CMB.2.raw
  modified_base (201)..(201): a, c, t, g, unknown or other
  modified_base (229)..(229): a, c, t, g, unknown or other
  modified_base (392)..(392): a, c, t, g, unknown or other
tcagactgtacagtcacgaccggtgctcgatttagagtagtgatcaggggggcagaagtctctctcagtcaggacacagcatggacatggagggtccctgctcagctcctgggactcctgctgctctggctcccagataccagatgtgacgtccagatcgacccagtcctccactccctccctgtctgctatctggtgganacagaatcagcatcacgttcggccgggngagtcgagggctagttagactaattattagccttaggtaatacaaacaaggaaaaccgaggggaacgtaacgttaccctaaagccttaccgtagtacttctagtcgctcgtcccctacctaccgtacctacctccggaacgggtccctattccgtacggttcncgggcgtacaggtgaactcgggaggacagtacttccacttctactaatacgcagcacgcctgactcgcgtaaaggagttcgtgttaacactttaactttataacgtagtaaactaaaattctaaactccttccttccccttgttacgtaccggtttacggggaacgggttacggaccggtaaggggtacgaacggttaacaaccgttaaaacggtcgttcggggtaaccg

SEQ ID NO: 425799 - DNA, 577 bp, Homo sapiens
  misc_feature: GZ8MTXP01C4O1W.25.4.A04.1.454.CMB.2.raw
  modified_base (483)..(483): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacagcttccggactcaccttggtgagcatgctatgacccgtgggtcccgccgaggcctccggaggggtaagggtctgggagtgggtcgttggggttcagttagaagcgaacgcctagtgggtggggacaaaacgacaagtaccgccgcgtactaggtaaaaggcagattcagcctctacaagagtatagaacttaccaaaagcaatccgactatctgacacagtgacncgacgcctaggaacgaaggcggaaggacctcgacggtccgtgttactttcgttcgtttaacttatttcctgtagttaggtaagttggttttaag

SEQ ID NO: 425800 - DNA, 527 bp, Homo sapiens
  misc_feature: GZ8MTXP01E0MC3.25.4.A04.1.454.CMB.2.raw
  modified_base (353)..(353): a, c, t, g, unknown or other
  modified_base (398)..(398): a, c, t, g, unknown or other
  modified_base (435)..(435): a, c, t, g, unknown or other
  modified_base (458)..(458): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttggcttaactgtcttttccttgttgctgtttaaaggtgtccaatgtgaggtgcaatggtggagtcgtgggggagcttggacagccaggccggtccctgacactctcctgcacagccttccggactcacctttggtgagcatgctatgaccgtgggtccgccaggcctccgagggagggtctgggagtggtcgttgggttcagttagagcgaagcctagngggtgggacaacacaaatacgccgcgtcgtaagtaaaaggcaagnttcagcctctcaagagatagacttaccaaagcagtcnctagtctgcacatgagcagtccngaagagcgaggctcgagccgttgttattcttgtttcttattctgtgtagtgttagttgtttaatttaac

SEQ ID NO: 425801 - DNA, 537 bp, Homo sapiens
  misc_feature: GZ8MTXP01DKWT9.25.4.A04.1.454.CMB.2.raw
  modified_base (268)..(268): a, c, t, g, unknown or other
  modified_base (369)..(369): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcaggcattagcaatattagcctggtatacaaacagaaaccagganagttcctaagctctgatctatgctgcctcagttacacctcagggtcccatctacggttcaagcgcagtgaatcgtgggacagattcatctcactatcgaancacgctcgcacgacgtagtaagtagtagttagtactaaacttaacttaacttaacgtaaataaaagttaaattaaacttaactacgttaccctaccttacgtacgttacggttacgggacgggaacggtaagggtaggaagaacgtaacgaaacgtaacgttaacgtg

SEQ ID NO: 425802 - DNA, 796 bp, Homo sapiens
  misc_feature: GZ8MTXP01BNAY6.25.4.A04.1.454.CMB.2.raw
  modified_base (270)..(270): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggcagtcagggcattagctaatattagcctggtaactcaaacgagaaaccgnggggaagtacgttacctaaaggccttaccgtagtacttcctaattcggtccttcggaccccttaccgtaaccgtttaaccgaccccgttaccggtacgggggttccccctaagtttcccgtacccggggtttaccaacgggtccgggtaccgtaagggttacggtaaaacgttccggggttaacggggaaactaacggttaacggtttacctaacccgttaccttaaccgtaacttaaactccgtaacgacccgaacgtccccgtaggccgtaaccggtaccggttaaggaaaacgggtttcgtttacggttaaccgtaaacctttaaacgttttaacgtttaaccgtttaaacgttaaaacgttaaaaacgtttaaccttaaacccgttaacccgttaccccgttaccccgtttaccgtttaaccggttaccgggtttaccggggaaccggggttaaccgggttaaccggtaaggggtacggtaaacgtaaccgtaaacggttaaacgtaacggttcgggtaacg

SEQ ID NO: 425803 - DNA, 642 bp, Homo sapiens
  misc_feature: GZ8MTXP01EHH5U.25.4.A04.1.454.CMB.2.raw
  modified_base (220)..(220): a, c, t, g, unknown or other
  modified_base (241)..(241): a, c, t, g, unknown or other
  modified_base (251)..(251): a, c, t, g, unknown or other
  modified_base (284)..(284): a, c, t, g, unknown or other
  modified_base (392)..(392): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttgagacagaatcagcatcacgttgccgggnagtcgaggcattagactaatnttagctgtanacaaacagaaacgaggatagttactaagctacngatctatcgctcgcctacacgttacacccgtcgacggggtccctagttccgtcggttcaaggcgactagtgaatcggtagggaactgtacttcaactctacaacttanacgtaacgccgaaccgccgtagaccgtacgtacggttaaggtaacgttacgttacgttaacgttaaccttaaacgtttaacgttaaacgtaacgttaaaacgttaaaacgttaacttaaaccgttaaccgttacccgttaccccgttacgttaccggttaaccggttacggggaaccgggttaaacgggttaaccggtaagggtacggtaacgtaacgtaaacggttaaaccggtaacgttcgggtaacg

SEQ ID NO: 425804 - DNA, 611 bp, Homo sapiens
  misc_feature: GZ8MTXP01ATQ9A.25.4.A04.1.454.CMB.2.raw
  modified_base (307)..(307): a, c, t, g, unknown or other
  modified_base (587)..(587): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaactggtggagtcgtgggggagcttggtacagccaggccggtcctgacactctcctgcacagccttccggactctaccgtttggtgagcatgctatcgacccgtcgggtccnccgaggcctaccgaagggggaagggtctgggaggtggcgtttggggttcagttaaggaaggtcgaacgcccctagtggggtaggggacaaacgaacaacgtaaccgccgtacgtactaaggtaaaaggcaagtacttcacgtcctactacaaggagatagtaacttacccaaaagctaatccgaccttaacgtctgacacgatcgacgcgacgtccgtaggacgaagcggaacgtcgttcgacgttccggttattacttacgttgtttactttaatactntaggagttagttaagttgtttaac

SEQ ID NO: 425805 - DNA, 660 bp, Homo sapiens
  misc_feature: GZ8MTXP01DW8XL.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctggttggagacagaatcagcatcacgttggccgggagagtcagggcaattagactaattatttagccttggtaactacgaaacaaggaaaaccgaggggaatacggtttaccaagccttcctagattctatcgcttcgccctacctacgttaccaccgtccggtacggggtccctagttcgtacgggttcaaggcggtacaggtacgtaagtccggtagggggtaactaggtaacgttccaaccttcctactaactttaaccacgacgccacgcctagaccgtacggtacgtaaggtaagttacgttacgttactaacgtttaaactttaacgttaacgttaacgtaaaactaaagttacctaaacttaaccctccgttacccttcgttaccgttaccggttcggggaacgggttaacggttaaccggtaagggtacgtaacgtaacgtaacgttaaacgtcgttcggtaacg

SEQ ID NO: 425806 - DNA, 720 bp, Homo sapiens
  misc_feature: GZ8MTXP01EV8KC.25.4.A04.1.454.CMB.2.raw
  modified_base (221)..(221): a, c, t, g, unknown or other
  modified_base (499)..(499): a, c, t, g, unknown or other
  modified_base (530)..(530): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggngagtcgagggctaattagactaaattattagccttaggtaactacaaacgaagaaaaccgaggggacgtacgtttacccaagccttaccgtagtacttctaacgttcggtcctacggtccccttaccgtaaaccgttaccaacccgttccggtacggggtcccctacgttccgtaccgggttacaacggtccgggacgtaaggtagaacgtttcgggacgggaaacctagtaaccgttccaaccttctaaccacttaacgcaacgccgtaacgccgtnaccgacggtacccgtaagtaaaaccgggttntttacggtaacttaaaccgttaaactttaatttaaaccgtaagtaaaacgtaaaacgtttactaaacgtaaccgttcccgttaccccttacgttaccggttaccggttaaccgggggacgggttaaacgggttaacggtaaggggaacggtaacgtaacgtaaccgttaaacggtaacgttcgggtaacg

SEQ ID NO: 425807 - DNA, 613 bp, Homo sapiens
  misc_feature: GZ8MTXP01A0KXM.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttagttttaaaaggtgtccaatgtgaggtgcaactggtggagtcgtgggggagcttggtacagccaggccggtccctgacactctcctgcacagccttccggactctaccgtttggtgagcatgctagtcgaccgtgggtcccgccgaggctccggaggggagggtcgtgggagtggtcgtttgggttctagttaggaagcgaagccgtagtggggtgggacaacgacaaacgtccgccgcgtacgtaaggtaaaacggcaagtacttcacgtcctactacgaagagatagacttaacaaagcatcgacctatcgtgaccacagtagacgacgacgtccgaggaacggaacgcggaacgggtaacctcgacggtccgttagttaactttacgttcgtttactttacgttaacctgtaaggtaggtagtttaggttaaggttttaattttaac

SEQ ID NO: 425808 - DNA, 525 bp, Homo sapiens
  misc_feature: GZ8MTXP01BPYVU.25.4.A04.1.454.CMB.2.raw
  modified_base (505)..(505): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttgggtacagccaggccggtccctgacactctcctgcacagccttccggactcacctttggtgagcatgctatgacctgggtccgccaggctccgaggggaagggtctggagtggcttgggttcattagaagcgaagcccctagtggtggggcaacaacaatcgcgcgtctagtaaaggcagattcagcctctcaagagatgattaccaaagcatcgcctatctgcacatgagcagcctgagaagcggaaggaacttcgagccgtgtattacgttgttcttaattactntgagttagttgttggtttaa

SEQ ID NO: 425809 - DNA, 505 bp, Homo sapiens
  misc_feature: GZ8MTXP01BRX41.25.4.A04.1.454.CMB.2.raw
  modified_base (219)..(219): a, c, t, g, unknown or other
  modified_base (264)..(264): a, c, t, g, unknown or other
  modified_base (269)..(269): a, c, t, g, unknown or other
  modified_base (370)..(370): a, c, t, g, unknown or other
  modified_base (374)..(374): a, c, t, g, unknown or other
  modified_base (376)..(376): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaatattagcctggtatcaaacagaaaaccnggganagttccaaagctctgatctatgctgctcacgtacacctcaggtccgactctcgttcaacgcgcgagtagatacgtgggacagagtcactctcactatacancacncncgcacgcgtagaagtatagtagtactaacttaatatataataaataaataataactacttcctcttacgtacgttcggttacggacggaacggaaggtaggaagaagtaacgaaacgtaacgttaagtg

SEQ ID NO: 425810 - DNA, 531 bp, Homo sapiens
  misc_feature: GZ8MTXP01A3DI3.25.4.A04.1.454.CMB.2.raw
  modified_base (194)..(194): a, c, t, g, unknown or other
  modified_base (221)..(221): a, c, t, g, unknown or other
  modified_base (348)..(348): a, c, t, g, unknown or other
  modified_base (364)..(364): a, c, t, g, unknown or other
  modified_base (387)..(387): a, c, t, g, unknown or other
  modified_base (413)..(413): a, c, t, g, unknown or other
  modified_base (460)..(460): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttggccgggngagtcgagggcattagactaattattagcctggtaatacaaacagaaaccgagggagacgttacctaagctcctgatctatgctcgcctccacgttacaccctcgacgggtcccagtcgtacgttcngcggcagtgaatcggnggacagtagtcactctcacttancagcacgctgacacgcgtagaacgtnttagttacgacttaattattaactgtaaactaaaagttataacttcncttcccgtcttcgtaccggttcgggacgggaacggacggtaagtgaagtacacgaaacgtcgttgtaaccg

SEQ ID NO: 425811 - DNA, 699 bp, Homo sapiens
  misc_feature: GZ8MTXP01B9ZA8.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactgggtggagtcgtgggggagcttggtacagccaggccggtcctgacactctcctgcacagcttccggactctaccgtttggtgagcatgctatcgacccgtgggtcccgccgacggccgtccggaagggggtaacggggtcgtggggtacggttgggtccgttttgggggttacaagtttaaggaaggtaccggaaaccgtccgttaaggtgggggtcgggggaaccaaaaaccgaacctaacggtacccggcccggtacggttacgtaagggttaaaaacgggcgaaaggtacttaccgacggtcccttactacgaaaggtaagtaagttagtaacttaacccgaaaaagtcctaacgtcccgtacccttaatccttacgacaactatacggacgccgacgtcccgaggaacggaaacggtcggaaggttactcgacgtaccgttgttaactttcttgtttaaccttattaacctgtagttagtaagttaagtttaag

SEQ ID NO: 425812 - DNA, 686 bp, Homo sapiens
  misc_feature: GZ8MTXP01B7VWP.25.4.A04.1.454.CMB.2.raw
  modified_base (222)..(222): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacgttggccgggngagtcgagggcattagactaattattagccttaggtaactacgaaacaaggaaaaccgaggggaactacgtttacctaaagccttaccgtagtacttctagtcgacctcgacccttaccgtacgttaccacccgtccggtacggggtcccctagtcccgttacgggttcaagggccggtacgaaggttacgaacgttcggtaggggaactagtacgtttaccaacttctactaacgttactcgaacgcacgtcccgtagaccgacgtaccgttaggaaacggtttgttacggttaacgtaaaccttaaactttaattaacgttaaagttaaacgtaaaattaactaaaccttaacccgtcccgttaccccttacgttacggttaccggttacggggaacggggttaacggttaacggtaaggggtacgaacggtaactaacggaaacggttaacgttggtaacg

SEQ ID NO: 425813 - DNA, 526 bp, Homo sapiens
  misc_feature: GZ8MTXP01EFFQI.25.4.A04.1.454.CMB.2.raw
  modified_base (268)..(268): a, c, t, g, unknown or other
  modified_base (336)..(336): a, c, t, g, unknown or other
  modified_base (355)..(355): a, c, t, g, unknown or other
  modified_base (401)..(401): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaatattagcctggtatcaaacagaaaccaggganagttaccaagctcctgatctatgctgcctcacgttacacctcgtacggggtcccatccgtacggttcngtcgggcagtcgattcggngacagagttcactctcactatcagcacgcctgcagccgtgaaagtntagttagtacctaaatttattaaccttataacaaaagttataaactaactcgttcccctacttcgtacgtttcggcgggttacgggaccaagggtgaagtactacgaaacgtaacgttgtaacgg

SEQ ID NO: 425814 - DNA, 654 bp, Homo sapiens
  misc_feature: GZ8MTXP01A47QX.25.4.A04.1.454.CMB.2.raw
  modified_base (194)..(194): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttggccgggcgagtcgagggcattagactaatattagccttggtatacaaacagaaaccgagggatagttcctaagctcctgatctatcgctcgccctaccacgttacacccgttacgacggggttcccagttccgttacgggttacaagggccggactagggttagaaacgtcggtacggggaaacctagggtacttccacttcctactaacttactccgagtccacgtcctaggacacggccgttaggaaagttagttacggttacgtaccttaaacttttacgtttaacctaaggttaaacctaaaagtttaacttaaacgtaaccttacccgttccccgttacttcccgtaaccgggtttacggggaccgggttaacggggttaaccgtaaaggggtcgaaacgtaacgtaaccgaaaacggtaacgttaacgggtccg

SEQ ID NO: 425815 - DNA, 682 bp, Homo sapiens
  misc_feature: GZ8MTXP01EE5I6.25.4.A04.1.454.CMB.2.raw
  modified_base (220)..(220): a, c, t, g, unknown or other
  modified_base (268)..(268): a, c, t, g, unknown or other
  modified_base (272)..(272): a, c, t, g, unknown or other
  modified_base (345)..(345): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccggngagtcgagggcatagctaatattagcctggtatacaaacagaaaccgngganagttccaagtctactgatctatgctgccctacacgttacacccgtcgacggggtcccagtcctaccgggttcngggcgacgtaggtagaaactccggtaggggtaacctaaggtacgtttaccaacttaccctacgtaacttacgtacaacggccaacgtccccgtgaccgacggtacccggttaagaaagggttacttagggtttaccgtaaccgttaaaaccgtttttaacgtttaaaccttaaggttaaaacccgttaaaaaagtttaaacttaaacgttaaccccgttccgttacccccttaccgttaccgttaacccgggtttaccggggaccggggttaacgggttaacccgaaaggggttcggaaacgtaactaacggaaaccgtaacgttgggttaaccggg

SEQ ID NO: 425816 - DNA, 569 bp, Homo sapiens
  misc_feature: GZ8MTXP01EPUBG.25.4.A04.1.454.CMB.2.raw
  modified_base (192)..(192): a, c, t, g, unknown or other
  modified_base (218)..(218): a, c, t, g, unknown or other
  modified_base (269)..(269): a, c, t, g, unknown or other
  modified_base (423)..(423): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtganacagaatcagcatcacttggccgggngagtcagggcatagctaatattagcctggtatacaaacagaaaccaggganagttccaagctactgatctatgctgcctcacgttacacctcgacgggtcccagtcctacggttcaaggcgactagtagaacgtcggtaggggacctagtaacgtttcaactctacaacttaactcaagcacggccctgacacgtcgtagaagtnttggttacacttaaactttattaacctagtaaactaaaagttactaataacctcgttccccttacgttacgtacggtttacgggacgggagggttacccgtaagggtggaacgtaacgttacgaaaacggtccgtttggtaaccgg

SEQ ID NO: 425817 - DNA, 614 bp, Homo sapiens
  misc_feature: GZ8MTXP01CALNC.25.4.A04.1.454.CMB.2.raw
  modified_base (280)..(280): a, c, t, g, unknown or other
  modified_base (290)..(290): a, c, t, g, unknown or other
  modified_base (299)..(299): a, c, t, g, unknown or other
  modified_base (322)..(322): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccagggccggtccctgacactctcctgcacagccttccgactcactttggnagcatgctangcctggccncaggctccgaggggaggtctggngtggcgtttgggtcagttagaagcgaagccctagtggggtgggacaaacgaaacaagtccgccgtacgtacgtaggtaaaacggcaagtattcacgcccttacacaaagaagtatagtaacttaccgaaaagccaatccgacccttaagtcttacgaccaaacgagtacgacgacgacgacgtacgaacggaacggacggaacggacgttacgtacgttcgttacgtttactttacgtttcgtttactttaacttacttaacgttagtagttaggttaagtttaagtttaag

SEQ ID NO: 425818 - DNA, 590 bp, Homo sapiens
  misc_feature: GZ8MTXP01ASDPQ.25.4.A04.1.454.CMB.2.raw
  modified_base (222)..(222): a, c, t, g, unknown or other
  modified_base (417)..(417): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttaggagacagatcagcatcacgttcggccggnagtcgagggcagttagctaaattattacgcctaggtatacgaaacaagaaaccgagggatagttaccctaaagcctaccgtagacttcttattgcttcgccctactaccgttacaccgtcgacgggtccctagtcgttcggttacaaggcgacagtgaactcggtacgggacagtacgtcaactctacaacttanactagaccacggcccctagctacgccgtagagttacgtcgttacacttaactttagttaactcgtaaactaaaacgttactaaactccttaccgcccttacgttaccgtaacggttcgggacgggttacggaacgtaagggtaggaactacgtaaccgaaagtccgttgtcgg

SEQ ID NO: 425819 - DNA, 647 bp, Homo sapiens
  misc_feature: GZ8MTXP01BPNYX.25.4.A04.1.454.CMB.2.raw
  modified_base (224)..(224): a, c, t, g, unknown or other
  modified_base (470)..(470): a, c, t, g, unknown or other
  modified_base (474)..(474): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgcatctggtaggagacagaatcagcatcacgtcggccggngagtcgagggctattagactaattagttacgccgttaggtaactaccaaaacgaacggaaaaccggtgggaaacgtaccgtttaccctaaaggtcccttaccgtagtaacttctagtcgcctacgtacccctacctaacgttaccaccgtccggtaacggtccctagtccgttaacggtcaaggggcgtacgtagtacgtaacgtcggtacgggactaggtctacactctacatactcgagtaccncgcngactacgacggtaagtaagttctacgtactaacttaaacgtttattaacgtaagtaaaactaaacttactaacctaaccgtcccttacccttacgttacggttaccgggtacggggaacggttaacggaacgtaagggtacgaacgtaacgtaaccgaacggtcgttcggtcg

SEQ ID NO: 425820 - DNA, 615 bp, Homo sapiens
  misc_feature: GZ8MTXP01C0XLL.25.4.A04.1.454.CMB.2.raw
  modified_base (284)..(284): a, c, t, g, unknown or other
  modified_base (308)..(308): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaactggtggagtcgtgggggagtcttggtacagccgaggcccggtccctgaccactctcctgcacagccttccggactctacgtttggngagcatgctagtcgacctgggccncaggctcgaggggacggtctggagtggtctttgggtcagttagaagcgaacgcccgtaggtgggtgggaccaaacgaaacaaatccggccgtacgtacgtaaggtaaaaggctaagacttcacgcctacagaaagagatagtaacttaaccgaaaagcaatccgaccttagtctgaccacatgacgacgacgccgtagagaaggacggaacggacgttacgtaacgttccgttagttactttacgtttcgtttactttaactttaccttaacgttaggtaggttagtttaaggttaaggttttaaag

SEQ ID NO: 425821 - DNA, 697 bp, Homo sapiens
  misc_feature: GZ8MTXP01EO7CL.25.4.A04.1.454.CMB.2.raw
  modified_base (302)..(302): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgtttaaaaggtgtccaatgtgaggtgcaactggtggagtcgtgggggagcttggtacagccaggcccgtccctgacactctcctgcacagccttccggactcgtacctttggcgagcatgctagtcgaccgtggtcccnccaggcctccgagggaaggtctaggagtggtcgtttgggttacagttagaagcgaaagcctaagtgggtaggggacaaacgacaaaataccgccggacgtacgtaggtaaaaaggccaaggtaatttcaacgtcctacacgaaagagaagttagaactttacccgaaaagtcctaacgtccgtacccttaagttcccggttaacgaacctaacgtagtacgacgtaccgtacggtacccgtaaggaaacggtaacggtaccgggtaaacggtaacccttaccggttaaccggttaccggtttaagtttaacgtttaacgtttacgttttacctttaacgttaacgttacgtaaggtaacggttaggtttacggtttaacgttttaacgtttaacg

SEQ ID NO: 425822 - DNA, 604 bp, Homo sapiens
  misc_feature: GZ8MTXP01DOHZG.25.4.A04.1.454.CMB.2.raw
  modified_base (191)..(191): a, c, t, g, unknown or other
  modified_base (215)..(215): a, c, t, g, unknown or other
  modified_base (228)..(228): a, c, t, g, unknown or other
  modified_base (243)..(243): a, c, t, g, unknown or other
  modified_base (248)..(248): a, c, t, g, unknown or other
  modified_base (270)..(270): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtcagatgacccagtctccatcctcctgtctgcatcgtgtgganacagaatcagcatcacttgccggnagtcaggcattanatatatagctagtanacaanagaacgaggtagtacgtacacnctacgtagtactactatactcgtacctactaacgtacacgtaccgtacggtctatcgtcgtacacgcgactagtagacgtcgacggacgtagtacgtactactactactactatacacgacacgacgcgacgacgtacgtacggtaacgtaagttagttacgtacgttaacttaacgttaacgttaactaaacgtaaaacttaaacgttaaactaaccgtaaccgtacccgttaccgttaccgttaccggttacgggtacgggttaacgggttaacggttaacgggtaaggtaacgtaacgtaacgtaaacgttaacgtaacgttaacgtaacg

SEQ ID NO: 425823 - DNA, 563 bp, Homo sapiens
  misc_feature: GZ8MTXP01B981F.25.4.A04.1.454.CMB.2.raw
  modified_base (221)..(221): a, c, t, g, unknown or other
  modified_base (377)..(377): a, c, t, g, unknown or other
  modified_base (381)..(381): a, c, t, g, unknown or other
  modified_base (385)..(385): a, c, t, g, unknown or other
  modified_base (413)..(413): a, c, t, g, unknown or other
  modified_base (534)..(534): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccactcctccctgtctgcatctgtggagacagaatcagcatcacgtggccgggngagtcgagggctattagactaaattagttacgccgttaggtaataccgaaacgaacggaaaaccgagggggaactacgtttaccctaaggtcctcctagtacttctatcgcctcgccctactacgtacaccgtcggacgggtccagtcgtacgtcngcgnagtnagtcgagggacagtacgttccactctanacttagacagcaacgcctagctacgcgtagaagtcttgttacaacttaattacgttaactagtaaactaaagtataaacgtcctcgttcccctattcgtacggttcgggacgggacgacgnggtacgaagacacgaacgtcgttgtcggg

SEQ ID NO: 425824 - DNA, 787 bp, Homo sapiens
  misc_feature: GZ8MTXP01A2FP1.25.4.A04.1.454.CMB.2.raw
  modified_base (196)..(196): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacgttcggccgggcgagtcgagggctatagactaattattagccttaggtaactaccgaaacgaacggaaaaccggaggggtaactaacgtttacccaaagtccttccgtagtattaccgtaatcggccttaccggtaccccttaccgtaaacggtttaccaccccgttaccgggtaccgggggttcccctagtttcccgttaacgggttaccaagggtcccgggtacgtaaagggttacgtaaacgtttccggtaaggggggaaactacggttaacgttcctaaccttcctaacctaactttacgacgtaaacggtcctaacggtcccctaggtaccgaacgggtaccgtttaaaggaacggtttaattcgggtttaaccgtaaccttaaaacgttttaacgtttaaactaacggttaaaaccttaaaaggttaacttaaacctcccggtttaccgttaccccctttaggttacccgttaaccgggtttaccgggggaacggggttaaccgggttaaccggaaaggggttacggaacggttaaccaacgggttaaaccgtaaggttcggtaaccgg

SEQ ID NO: 425825 - DNA, 810 bp, Homo sapiens
  misc_feature: GZ8MTXP01AYAXB.25.4.A04.1.454.CMB.2.raw
  modified_base (225)..(225): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccatatgtgacgtccagatgacccagtcctccatccctccctgtctgcatctggttggagacagaatcagcatcacgttcggccgggngagtcgagggctaattagactaaattattacgccgttaggtaactacgaaacgaaacggaaaacccgaggggtaaagtacgtttaccgtaaaggtccttacccgtagaactttacctaagttcggtaccttacggtacccccttaaccgtaaccggtttaaccaccccgttaccggtacgggggttccccctaagttcccgttaacccgggtttacaagggtccgggactaacgggtacgtaaacgttcgggttacggggaaactacggttacggttaccaaccctttaccttaccgaaactttaccgtacgaaacggccaaaccgggccttacgggacaaccgggtcctttaaggggaaaccgttagttaccgggtttagtaaaccccgttaaagtttttaactttaaccgttaaaggttaaacccgtaaaaaagtttaacgtaaacgttaacccttccggttacccccttaccgttccgttaaaccgggtttaccggggaaccgggttaacgggggttaacccgtaagggggttacggaacgtaacggtaacccgttaaaagggtccgttaagggtaaccggg

SEQ ID NO: 425826 - DNA, 815 bp, Homo sapiens
  misc_feature: GZ8MTXP01BXLJ5.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagttggcttaactgtctttccttgttgctgtttaaaggtgtccaatgtgaggtgcaactggtggagtcgtgggggaggcttggtacagccgaggccggtccctgacactctcctgcacagtccttccggactcaccgtttggtgagcatgcttagtcgacccgtggggtccccgaccgacgggtcctaccggaagggggtaacggggtcgtggggtaggtgggtcgtttgggggttactaagtttaacggaaaggtccggaaacggtcccgttaaggtgggggtacgggggaccaaaaaaccgaacgtaacgttacccggcccggtaccggttaccgttaagggttaaaaacgggctaaacggtactttaccgacggtaccccttacgtaccgaaaagggtaacggtaagttacgggtaaacctttaacccgaaaaaaacgggtccctaaacgttccccgggttaccccgtttaaagttacccgttcggacccctaacgtaacgttggtaaccgaccgaacggtaccccgttaagggaaacgggtaaacgggccggtaaacggggaccttaccggacggttaccccgggtttagtttaaacgttttccgtttcggttttaaccctttatttaacccgttacgttaggttaaacggttaacggttttaaggtttttaacggg

SEQ ID NO: 425827 - DNA, 704 bp, Homo sapiens
  misc_feature: GZ8MTXP01DPSD2.25.4.A04.1.454.CMB.2.raw
  modified_base (299)..(299): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgtcttttcctgttgctgtttaaagtgtccaatgtgaggttcaactggtggagtcgtgggggagcttggtacagccaggccggtccctgacactctcctgcacagcttccggactctacctttggtgagcagtgctatcgaccgtgggtcccncaggctccgagggaaggtctaggtagtcggtcgtttgggtttacagtttacggaaacgtacggaaacgtccgttaacggtcgggggtagggggacctaaaaccgaaccgtaaaaaaccgttaacccggcccggtacgttaccgtaaagggtaaaaaacgggcctaaggtacttacacgtcctctacgaaagagtaatagtaacttaaccgaaaaacgctaacgttaccgtaccttacgtacggtacgtactaaacgagtacgacgcgaacgtaccgtaaggaaacgaacgggacggaaacggtaaccgtacgttaccggttcgttagtttaactttacgttacgttttactttaacgttaacttacgtaagtaaggttagtttaggtttaacgtttaagtttaac

SEQ ID NO: 425828 - DNA, 793 bp, Homo sapiens
  misc_feature: GZ8MTXP01BBNAM.25.4.A04.1.454.CMB.2.raw
  modified_base (287)..(287): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgtcttagttttaaaaggtgtccaatgtgaggtgcaacgtggtggagtcgtggggggaggcttggtacagccagggcccggtccctgaccacctctcctgcacagccttccggactctaccgtttggngagcatgctagtcgacccgtcgggtccccgccgacgggccgtaccggaagggggtaacggggttcgtagggaggttcggggtcgtttgggggtttactaagtttaaggaaacgccggaaagtccgttaaggtgggggtacggggaccaaaaccgacgtaaaacgtacccggcccggtacgtacgtaagggtaaaacggctaaggactttaccgacgtccctacgtacgaaaggtacgaattacggtaaacttaacccgaaaagcctaagtaccgtaccttaagtccgttacgaccaacgttaagacggaacgaccgaacggttacccgtaaagggaaggaaaccggccgggaaacggtaacccgttaaccggaggttaccccggtttaagtttaaacttttaacccggtttcgtttttccttttaaacgtttaaccttaccggttaagggttaaacggttaacggttttaacgggttttaaggttttttaaaactttttaaaaccg

SEQ ID NO: 425829 - DNA, 601 bp, Homo sapiens
  misc_feature: GZ8MTXP01CHMIT.25.4.A04.1.454.CMB.2.raw
  modified_base (284)..(284): a, c, t, g, unknown or other
  modified_base (362)..(362): a, c, t, g, unknown or other
  modified_base (407)..(407): a, c, t, g, unknown or other
  modified_base (415)..(415): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctccctgtctgcatctgttggagacagaatcagctatcacgttggccgggcgagtcgagggcagttacgactaattattagccttaggtactacaaacgaacgaaaaccgngggatacgttacctaagctactgatctatgctcgcctcacgttacaccgtcggacgggtccctagtccgtacggtacngcgggtacaggttagaacgttcggagggactaggtacttcactcncgacttanacacgcgacgcgcgacgacgtacggtagtagtagttagttacgttaacttaacttaacttaacttaacgtaaactaaacttaaacttaactaacctccgttcccttccgttaccgttacggttacgggttacgggacggttacggtaacggtaggtaacgtaacgtaacgaacgtaacgttcgtcg

SEQ ID NO: 425830 - DNA, 542 bp, Homo sapiens
  misc_feature: GZ8MTXP01AZAE2.25.4.A04.1.454.CMB.2.raw
  modified_base (277)..(277): a, c, t, g, unknown or other
  modified_base (303)..(303): a, c, t, g, unknown or other
  modified_base (523)..(523): a, c, t, g, unknown or other
  modified_base (527)..(527): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagcttccggactctacctttggngagcatgctagtgaccgtgggtcccnccaggctccgaggggaggtctagtagtggtctttgggttcagttagagcgaagcccgtagtgggtgggacaacgaacaatcgccgcgtactagtaaaaggcaagtattcagcctactacaagagatagacttaccaaaagcatcgcctatctgcacatgagcacgcctagaagacgcgaaggacttcagttccgtagtattacgttgttcttaatacgtntagngttagtgttgtttaa

SEQ ID NO: 425831 - DNA, 572 bp, Homo sapiens
  misc_feature: GZ8MTXP01B4DYM.25.4.A04.1.454.CMB.2.raw
  modified_base (450)..(450): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgctgtttaaaggtgtccaatgtgaggtgcaactggtggagtcgtgggggaggcttggtacagccaggccggtccctgacactctcctgcacagcttccggactcacctttggtgagcatgctatgacctgggtcccgccaggcctccgaggggaggtctgggagtggcttgggtcattagagcgaagcctagtggtggggacaaacacaatacgccgcgtctaggtaaaaggcaagacttcgacgcctctcaagagatgacttaccaaaagcatccgctatctgcacnctgagcacgtcctaggaacgaacgggcgaacgggttacctcgaacggtcccgttaggttaactttcgttcggtttaactttactttaacgttcgttaggacgttaaggttaaggttttaagg

SEQ ID NO: 425832 - DNA, 726 bp, Homo sapiens
  misc_feature: GZ8MTXP01BXMFH.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccgaggcccggtccctgaccactctcctgcacagccttccggactctaccgtttggtgagcatgctatcgacccgtgggtcccgccgagggcctccggagggggtaacgggtcgtgggagtggtcgtttgggttcagttagagcgaacgcctagtgggtgggacaaaacacaagtaccgcccgtacgtcgtaaggtaaaacggcaagtacttccgacggtccctacgtacgaaaggtaagtattacgtaacttaacccgaaaaaggtcctaaacgttacccgacccgtttaacttccgttacggaccctaacgtaagttacgggaacgtaccgacgggtaccccgttaagggaaacggaaacgggaaccgggaaacgggttacccttacggaaccgggttcccggtttaagtttaacgttttaccgtttcggttttaaccttttaacgtttaaccgttacggttagggttaaggttaaggttttaaggttttaagg

SEQ ID NO: 425833 - DNA, 632 bp, Homo sapiens
  misc_feature: GZ8MTXP01BJW0I.25.4.A04.1.454.CMB.2.raw
  modified_base (220)..(220): a, c, t, g, unknown or other
  modified_base (416)..(416): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgtggccgggngagtcgagggcattagactaatattagctggtatacaaacagaaaccgaggagacgtacctaagctcctagactctatgctcgcctaccacgtaccactccgacggggtcccacgtccgttcggttcgcggcggacgtagtacgtaacgtccgtaggggaacctagtacgttactaacttcctactaactttaacncaacgccaacgcccgtgaccgacgtacccggtagtaaagtaccgttaggttactaaccgttaaacgtttaactttaaccgttaagttaaaccgtaaaatttaacttaaacttaaccgtacgttcccccttacttaccgtaccgtttacggggaccgggttacgggttaaccgtaagggtacggaacgtacgtaacgaaacgtaacgttggtaacgg

SEQ ID NO: 425834 - DNA, 697 bp, Homo sapiens
  misc_feature: GZ8MTXP01A4TKD.25.4.A04.1.454.CMB.2.raw
  modified_base (244)..(244): a, c, t, g, unknown or other
  modified_base (278)..(278): a, c, t, g, unknown or other
  modified_base (289)..(289): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccaggccggtccctgacnctctcctgcacagcttccggactctacctttggngagcatgctancgaccgtcgggtcccgcaggcctaccggaggggaaggtctggagtggtctttgggtcagttagaagcgaaagtccgtaagtggggtagggacaaacacaaaaagtccggcccgtacgttactaaagggtaaaaacgggctaaacggtactttaccgacgtccctaccgtaacgaaagggtataacgtacggtaactttaaacccgaaaagctaactacccggtacctttaacgcgtacgaccaacgtacgtacggaaccgcgtaacggaccggtaagggaacggaacggtaccggaacggtaacctacggttacggtaccgttaagtttaacgtttaccgtttacgtttctttaacgtaaccgttagtaaggtaggttaagtttaggtttaacgttttaactttaacg

SEQ ID NO: 425835 - DNA, 586 bp, Homo sapiens
  misc_feature: GZ8MTXP01AUAIX.25.4.A04.1.454.CMB.2.raw
  modified_base (296)..(296): a, c, t, g, unknown or other
  modified_base (468)..(468): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagcttccggactcacctttggtgagcatgctatgacctgggtccncaggctccgagggaaggtctggagtggcttgggttcagttagaagcgaagcctagtgggtggggacaacacaaataccgccgcgtctagtaaaaggcaggattcagtccctctacaagagatgaacttaccaaaaagcaagtccgcctaatcctgcacagtgagcacgccgngagaacgacggaggaacgtcgaacgtcccggttacggttaagtttaacttcggtttctttactttaacttaccgttaacgtaaggtaggttaggttaacgggtttaagtttttaaacg

SEQ ID NO: 425836 - DNA, 598 bp, Homo sapiens
  misc_feature: GZ8MTXP01AJ12T.25.4.A04.1.454.CMB.2.raw
  modified_base (220)..(220): a, c, t, g, unknown or other
  modified_base (334)..(334): a, c, t, g, unknown or other
  modified_base (347)..(347): a, c, t, g, unknown or other
  modified_base (355)..(355): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcgagggcattagctaatattagcctggtatcaaacagaaaccaggagagttacctaagctcctgatctatgctgcctcacgtacacctcgacggggtcccatctcggttcngcgcagtgatcgngggacagngttcactctcactactcagcacgcctgacacgaccggtagaaagtacgttgtttaacgtaccttaaactttaactttaacgtaacggttaactaaaaaaaggtttacttaaacttaaccctcggttaccccccttaccgttaccgttaacccggtttaccgggggacccggggttaacggggaacccgtaaagggggtacggaacggtaactaaccggaaaacggtaacgttcggtaaccggg

SEQ ID NO: 425837 - DNA, 575 bp, Homo sapiens
  misc_feature: GZ8MTXP01AOG1T.25.4.A04.1.454.CMB.2.raw
  modified_base (194)..(194): a, c, t, g, unknown or other
  modified_base (372)..(372): a, c, t, g, unknown or other
  modified_base (382)..(382): a, c, t, g, unknown or other
  modified_base (395)..(395): a, c, t, g, unknown or other
  modified_base (539)..(539): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtctccatcctccctgtctgcatctgtgganacagaatcagcatcacgttggccgggcagtcgagggctaattagactaattgttacgccttaggtatacaaacgaacgaaaaccgagggactacgttaccaaggcctacctagacttcctatcgtctcgtaccctacgtaacttacacccgttcggacgggtcccagtcgtacggtcnggcgacagtnaagtcgtaggacngtagtcactcacactagtaccagcgtacgcctagcacggctagaaaggtcttagtacaacttattaattactagtaactaaagttactaatccgtcttccctacttacgacggttacggggcggttaacgggaccgttaagggngtaacgtaacgaccgggttaactaacgttgggaacg

SEQ ID NO: 425838 - DNA, 568 bp, Homo sapiens
  misc_feature: GZ8MTXP01A8C4Y.25.4.A04.1.454.CMB.2.raw
  modified_base (221)..(221): a, c, t, g, unknown or other
  modified_base (287)..(287): a, c, t, g, unknown or other
  modified_base (366)..(366): a, c, t, g, unknown or other
  modified_base (452)..(452): a, c, t, g, unknown or other
  modified_base (493)..(493): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggngagtcgagggcattagctaaattattagccttaggtaactacaaacgaagtaaaaccgaggggaanacgttacctaaagcctcctagattctatcgcctcgccctactacgttaccacctcggacgggtccctagtcgtcggtcnggcgtcaggtagactcgtagggacagtactcactctctacgtactacagtcaacggtcctgacgagccgtaagaagttatcgttanacttaacttattacgttagtaactaaaagtataacttaacncgttacccctgttaccgtacgttcggggacggaggaaccgtaaggaggtaacaactcgaaaacgtcgttggaacg

SEQ ID NO: 425839 - DNA, 715 bp, Homo sapiens
  misc_feature: GZ8MTXP01AEG0X.25.4.A04.1.454.CMB.2.raw
  modified_base (287)..(287): a, c, t, g, unknown or other
  modified_base (568)..(568): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaacgtggtggagtcgtgggggagtcgttggtacagccagggccggtcctgaccactctcctgcacacgccttccggactctaccgtttggngagcagtgctagtcggacccgtgggtccccgcgaggcctccggaagggggtaagggtcgtgggtagtgggttcgtttgggggttactaagttaaggaaacggcgaaacggtcccgttaaggtcgggggtacgggggacaaaaaccgaacgtaacgttcccggcccgggtacgttacgttaaagggaaaaacggggtcaaacggttacttaccgaacgtcccttacaacgaaagaggtactaggtaacttaaaccgaaaagctaacgtcccgactacttcgngaccaagtgcgacgacgcgtcgaaggaacgaacggcggtaagttacctaccggacggtaccgtttagttaaccgttttcgttacgttttaaccgtttaactttccgttagggttaggttaaggtttaacggtttaagggttttaacg

SEQ ID NO: 425840 - DNA, 689 bp, Homo sapiens
  misc_feature: GZ8MTXP01BWDJP.25.4.A04.1.454.CMB.2.raw
  modified_base (283)..(283): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaacgtggtggagtcgtgggggagcttggtacagccaggccggtccctgacactctcctgcacagtcttccggactctaccgtttggngagcatgcttagtcggacccgtcggggtcccgacccgaggggtccctacccggaagggggtaacgggttcgtagggggtaggttgggtccggttttgggggttaccaagtttaacggaaagtcggaaacgtccgttaggtgggggtacggggacaaaacgaacgaacgtaccggcccgtcgttacgtaaggtaaaaggcaaagtacttacgacgtccctactacgaaagagattacgaacttaacccaaaagctaatccgtaccttattcgtcgaccaacgtagtcgacgaccacggtacctaggaaacggagtaaccggaacggttaccttcgcggtaccgttagtttactttacgttcgtttaacctttattaaccttgtaggttaagttcgtttaagtttaag

SEQ ID NO: 425841 - DNA, 617 bp, Homo sapiens
  misc_feature: GZ8MTXP01DLV2D.25.4.A04.1.454.CMB.2.raw
  modified_base (221)..(221): a, c, t, g, unknown or other
  modified_base (268)..(268): a, c, t, g, unknown or other
  modified_base (272)..(272): a, c, t, g, unknown or other
  modified_base (289)..(289): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacgttggccgggngagtcagggcattagctaattattagcctggtatacaaacagaaacngganagttccaagctctgatntatgctgcctcacgttacacctcgagggtcccatcgtacgttcaaggcgacagtcgaactcgtagggacctagtacgttcactctacaacttatcaagcaacggcctaggctaacggcctagtaaacgtagttacgttagaaccttaaactttattaacccgttaggtaaaccgtaaaaaagttacttaaaacttaacccttaaccggttcccccttacgttaccgtaaccggttttccgggggaaccgggttaacggggaacccgttaaaggggtaccggtaagtaaccgtaccgttaaaaaccggtcgttaacgggttaacccggg

SEQ ID NO: 425842 - DNA, 582 bp, Homo sapiens
  misc_feature: GZ8MTXP01CD7Y7.25.4.A04.1.454.CMB.2.raw
  modified_base (194)..(194): a, c, t, g, unknown or other
  modified_base (357)..(357): a, c, t, g, unknown or other
  modified_base (363)..(363): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacgttcggccgggcgagtcgagggctattagactaattatttacgccttaggtatacaaacaggaaaccgagggagtacgttaccaagcctcctgatctatgctcgcctcctacgttaccaccgtcgacgggtcccatccgtcggttcnggcggntagtgaatcggtaggggacagtacgttcactctacatactcagcgacgcctgacgacgccgtaggaagttctacgtttacgaaccttaacgtttattaccgtagttaaacctaaaagttacttaaacgtaacctccgttccccttcttaccgttacgttcgggacgggttacggaccgtaagggttcgaagtaacgtacgaaacgtcgttcggtaacgg

SEQ ID NO: 425843 - DNA, 596 bp, Homo sapiens
  misc_feature: GZ8MTXP01CWB5A.25.4.A04.1.454.CMB.2.raw
  modified_base (221)..(221): a, c, t, g, unknown or other
  modified_base (406)..(406): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacgttggccgggngagtcgagggcattagctaattattagcctggtatacaaacagaaacagggaatagttacctaagctctgatctatgctgcctacctacgttaccacctcgacggggtccctagtccgtacggttacaaggcggctaaggtgaagtcgtagggacagtacgtacactcactaactatccagaccncgcctcgacgacgacggtacgtaagtacgtacgttacgtaacttaacttaacttaacttaacgtaaactaaacgtaaacttaacttaacctaccgttaccctaccgttaccgttaccggttacgggttacgggttacgggttaacggtaacggtacggtaacgaacgtaacgttaacgtaacgttcgtcg

SEQ ID NO: 425844 - DNA, 764 bp, Homo sapiens
  misc_feature: GZ8MTXP01AB9F5.25.4.A04.1.454.CMB.2.raw
  modified_base (195)..(195): a, c, t, g, unknown or other
  modified_base (221)..(221): a, c, t, g, unknown or other
  modified_base (270)..(270): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttgganacagaatcagcatcacgttgccgggnagtcgagggcattagctaattattacgctggtaatcaaacagaaaaccngggaagtacgtttaccaagccttcgtagactctatgcctcgcccttaccaacggtttaccaccccgtcggacggggtcccagttctaccgggttcaaggccggctaagggtacgaaacgttccgtaggggaacctaggtaacgtttccaaaccttctaccctaattacgtccgaaacggcccgaacggccccttggacccgtaacggtacccggggttaaggtaaaacggggttattttacggggttaaaccgttaaccgttaaacgtttttaaactttaaacccgggtttaacgtttaaaacttaaaaaaaagggtttaactttaaacccgttaaaccccttccccggtttaaaccccccttaaccggttaccggtttaaacccgggtttttccgggggaaccgggggttaaacccgggggaaacccgttaaaaggggtcgggaaaacgttacgaaacccgttaaaacgtaaccggttaagggttaacccggg

SEQ ID NO: 425845 - DNA, 666 bp, Homo sapiens
  misc_feature: GZ8MTXP01D7280.25.4.A04.1.454.CMB.2.raw
  modified_base (197)..(197): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtctccatccctcctgtctgctatctggttgganacagaatcagcatcacgttggccgggcagtcgagggcattagactaattattagccttaggtaatacaaacagaaaccgagggaagacgttacctaagtcctactagtactctagtgctcgccctaccgacttaccaccgtcgacgggtccctatccgttacgttcaaggcgactaggtagtaagtcgtaggggaacacggtatcctaacttctactaacttacgcaacgcaactccccggtagttaacgcccttaaggggaaacgttagttcggtttaacgtaacctttaaaccgtttaatttaaacccgtttaagtaaaaccgttaaaagtttaaacttaaacccgtttacgtaacccttaccccgttaccttaccggtttaccggttacgggggacggaaacggggttccgaaagggtaacggtaaacggaacttaacggaaacgttaccgtcggaagggttcccg

SEQ ID NO: 425846 - DNA, 773 bp, Homo sapiens
  misc_feature: GZ8MTXP01DDV5J.25.4.A04.1.454.CMB.2.raw
  modified_base (285)..(285): a, c, t, g, unknown or other
  modified_base (310)..(310): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcgttggtacagccgaggccggtcctgacactctcctgcacagtccttccggactctaccgtttggngagcatgctatcgaccgtcggtccnccgaggcctccggagggggacgggtcgtgggaggtggtcgtttgggtactaagttaggaagcgaaacgtccccgtaggtgggtaggggaccaaacgaacaagtccgccgtacgtactaaggtaaaacgcaagtacttcacgtcctacgtacgaaagtagaagttacgtaacttaaacccgaaaaacggcctaaacggttcccgtaccccttaaattcccgttacggtaaccaaaccgttaagtacggaacggtaccgtaaacggcccgttaaagggaaaggtaaaccgggtaccgggaaaacgggtacccttaaccgggtaaccggttaccccggtttaaaggttttaacgttttaccccgttttagggtttttaacccctttttaaatttaacccgttcggtttaaggggtaaacgggtttacgggttttaaacgggttttaacccgggtttttttaaaaac

SEQ ID NO: 425847 - DNA, 720 bp, Homo sapiens
  misc_feature: GZ8MTXP01DTTLB.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtggggggagcttggtacgagccgacggccgtcctgacactctctgcacagtcctccggactctacgtttggtgagcatgctatcgaccgtcgggtcccgccgagggccctccggaaggggtaacgggtcgtagggtaggttgggtccgtttgggggtttactaagtttaggaacggtacggaacgtccgttaaggtgggggtacgggggaccaaaaccgactaaaaacgtacccgggcccggtacggttaccgttaaagggtaaaaaacgggtccaagggttactttacccgacgtacccttacgtacgaaagaggtaagttacgtaacgttaaaccaaaacgaccaacgttccgtacccttacttaccgtttacggccaaaccgacgttaggacgacgtacgaccgtggaaggaacggcgggaacgaacgtacacggtaccgttgttaactttagttacttttcgtttaactttaacctgttggtagtaggttagtttaagggtttaattttaacg

SEQ ID NO: 425848 - DNA, 767 bp, Homo sapiens
  misc_feature: GZ8MTXP01EOB0G.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgcatctgtggagacagaatcagcatcacgttcggccgggngagtcgagggcagttagactaattattagccgtaggtaactacgaaacaaggaaaccgagggaagtacgttacctaaaggccttacctagtacttctaagtcggccttacgccctaccgtaacggtttaccacccgttaccggtaacgggggttccccaagttcccgttacccgggttacaacgggcccgggtacgtaagggtacgtaaacgtttccgggtaagggggaaaccctaagggttaccgtttaccaaacccgttccttaaccgtaaaccgtttaactaccgtaaacggtcccaaacgggttcccccgtacgaaccgtaaccggtaaccgggttaaggtaaacgttacgtttacggttaacgtaacctttaaacgtttaagttaaaccgtaaacgttaaaacttaaaacgttaacttaaaccttaaccgttacccgttacccttaccgttaccggttaccggttaccggggaacgggttaacgggttaaccggtaagggtagtaacgtaacgtaacgttaaacggtaacgttcggtcg

SEQ ID NO: 425849 - DNA, 590 bp, Homo sapiens
  misc_feature: GZ8MTXP01EGGUQ.25.4.A04.1.454.CMB.2.raw
  modified_base (214)..(214): a, c, t, g, unknown or other
  modified_base (245)..(245): a, c, t, g, unknown or other
  modified_base (255)..(255): a, c, t, g, unknown or other
  modified_base (370)..(370): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtcagatgacccagtctccatcctcctgtctgcatctgttgagacagaatcagcatcacttgcggnagtcaggcattagcaatattagctgatcaanagaacagganagttccaagctactgatctatgctgcctacacgttacacctcgacgggtcccatcgtcggttcaagcggcaggtcaagtctaggggaacagattcaactcttaccacgtttaacncgagacgacgccgtacgacgacgtacgtagtaagtagttagttacgtaacgttaactttaacttaacttaacgtaaacgtaaaacgttaaacttaaacttaacctaccgttacccgttaccgttaccgttaccggttacgggttacgggttaacgggttaacgggtaaacggtacgggtaacggtaacgtaacgttaaacggtaacgttaacggtaacgg

SEQ ID NO: 425850 - DNA, 725 bp, Homo sapiens
  misc_feature: GZ8MTXP01BNHYC.25.4.A04.1.454.CMB.2.raw
  modified_base (286)..(286): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaacgtggtggagtcggtgggggaggtcttggtacagccgaggcccggtccctgaccactctcctgcacacgtcttccggactcgtaccgttggngagcatgctagtcgaccgtcgggtcccgccgtaggccgtaccggaaggggtaacggggtcgtggggaggttcggggtcgtttaggggtttactaagtttaaggaacgtacggaaacgtccgtaaggtggggtacggggaccaaacaaccgaaaacgttacccggccggtacggttacgtaaacggtaaaacggcctaagtacttccgacgtcccttactacgtaaagagtagtaacgtaacgttaaaccgaaaacgtacctaacgttaccgtaccttaacttccgtacggacctaaccagtacggacgaccgacgtacccgtaggaaacggaacggacggaacggtaactacgcgtcccgttagttaactttacgttgtttctttactttaacgtcgttaaggtaggtacggtttagtttaaggttttaacttttaacg

SEQ ID NO: 425851 - DNA, 628 bp, Homo sapiens
  misc_feature: GZ8MTXP01DQBEH.25.4.A04.1.454.CMB.2.raw
  modified_base (194)..(194): a, c, t, g, unknown or other
  modified_base (244)..(244): a, c, t, g, unknown or other
  modified_base (508)..(508): a, c, t, g, unknown or other
  modified_base (536)..(536): a, c, t, g, unknown or other
  modified_base (556)..(556): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtcagatgacccagtctccatccctcctgtctgctatctgtgganacagaatcagcatcacgttgccgggagagtcgagggcaattgactaattnttagccttaggtactacaaacaggaaaccaggggaagtacgtttacctaaagccgtacctagtactcttagtcggaccttcgacccttaccaacgtttaccaccgtccggtacggggtaccctacgttccgtccgggtttacaacgggccggtctaaacgggttacgaaacggttcgtagggggaaccacggtaacgtttcaacctctactaaactacggtacaaggcaacgccctagacacgtcgtaaggaattaagtgttanaccttaattattacgtataactaaaatntaactaactccttaccttcnccgttaacgttcgggacgggttacgaaccggtaagggttacaagtaacgtacaaaccggtaagttggtaacg

SEQ ID NO: 425852 - DNA, 895 bp, Homo sapiens
  misc_feature: GZ8MTXP01EYSDD.25.4.A04.1.454.CMB.2.raw
  modified_base (271)..(271): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccgtcctgacactctcctgcacagcttccggactcaccttggngagcatgctagtcgaccgtgggtcccgccgaggcctacccggaagggggaacggggttcgtgggtaggttcgggtcgtttggggtttacctaaagtttaggaaacggtaccggtaaacgtcccgttaaggttcgggggttacggggggaacaaaacccgaaccgtaaaaaacgtacccgggtccccgggtacggtttaccgttaaacggggtaaaaaacggggtacctaacgggttaaacttttacccgaaaccggtccccttaccgttaaacccggaaaggtaaacggttaacgttaagggtaaaccttttaaaccccgaaaaaaaacgggccctaaaccgtttaccccggtaaccctttaacgttttaccgtacgggtaacccgaaacccttacgtagggtaaccgtaacccgaaccggggttaccccgtacggggtaaaacgggaaagggaaacccggggtaacggggtaaacccttacgggaaccggttaccccggggtttagtttaaaccttttaacggttacgtttttaccctttttaaggtttaacccttaccggttaaggttaaacgggttagggtttaaggggttttaaccggtttttaaagttttttaaacccg

SEQ ID NO: 425853 - DNA, 774 bp, Homo sapiens
  misc_feature: GZ8MTXP01D1XVT.25.4.A04.1.454.CMB.2.raw
  modified_base (230)..(230): a, c, t, g, unknown or other
  modified_base (298)..(298): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctccctgtctgctatctggttaggagacaagaatcagcatcacgttcggccgggngagtcgagggctaagttagactaaattagttacgccttaggtaactaccgaaacgaacggaaaaccgnggggaactacgtttacctaaggtccttaccgtagtacttctagtcgtccttacgtaccccttacgtaaccgttaccaccccgttccgggtaacgggttcccctaagttcccggttaaccgggttaccaacggggtccggtaacgtaagggttaaccgtaaacggttcggggtaacggggaaacctaacgggttaacgtttccctaaccttccgttaacctaaacgttactaccgaaacggtccaaccgggtccctacgaccgtaccgtacgggtaaggtaaaacggttcgtttacgggttaaccgtaacctttaaactttaagtttaaacccgtaagttaaaacgtaaaagtttaacttaaacttccccgttaccttaccccgttacgtttacggtaaccgggtttaccggggaacgggttaacggaaccggtaagggtcggaaacttacgaacgttaacgtaacgttggtaaccg

SEQ ID NO: 425854 - DNA, 698 bp, Homo sapiens
  misc_feature: GZ8MTXP01BIV34.25.4.A04.1.454.CMB.2.raw
  modified_base (513)..(513): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctcctgtctgcctattcgttggttaggaagacaagtaatcagctatcgtacgttgggcccgggagtacggtcgagggctaagttacgaattaaattattacgccgttaggtaactaacgaaacaaacgaaacggaaggtaagtacgttaacctaaggtccttccgtaagtacttactagtcggtcctaccggtaccccttaaccgaacgtttacctaccgttaccggggtaccgggtcccttaagttcccggttaacgggtaccgcgggcgtaactagggttacaacgtcgtaggggaactagtacttacctactacctacaaacttcacgagccccngtcacgacgacgtacggaagtagttacgtacgttactaactttaaacgtttataacgttaaataaacttaaactacttacctaaccttcccttacccgttacgttacgggttaccgggtacgggaacgggttaacggttaacggtaaggtacgtaacgtaacgtaacgttaacgtggttcggaac

SEQ ID NO: 425855 - DNA, 537 bp, Homo sapiens
  misc_feature: GZ8MTXP01BQDVI.25.4.A04.1.454.CMB.2.raw
  modified_base (275)..(275): a, c, t, g, unknown or other
  modified_base (342)..(342): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagactaattattagcctggtaatcaaacagaaaccaggganagttcctaagctctgatctatgctgcctccacgttacacctcgacggggtcccagtcctacggttcnggtcgcagtgaatcgtagggacagtagttcactctacactatcagcacgcctgacacgcctagaaagnttcgttgactaacctttattaacctgtaaactaaaagtacttaaataaccgtcgttccccttcgttctacgtttcgggacgggttaggaccgaagggtggaagtatacgaacgtaacgttggtaacg

SEQ ID NO: 425856 - DNA, 829 bp, Homo sapiens
  misc_feature: GZ8MTXP01DLKYW.25.4.A04.1.454.CMB.2.raw
  modified_base (219)..(219): a, c, t, g, unknown or other
  modified_base (377)..(377): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcattctgtggagacagaatcagcatcacttgccgggngagtcgagggcagttagactaaattagtttagcccttaggtaaactacgaaaccgtaacggaaaaccgaggggtaacgtacgtttacctaaacggccttaccgtagtaactttcgtaagttcgccttcggtacccccttaccgaaaccgtttaacccnccccgtaccggtaaaccgggggttcccctaagttcccggttacccgggtttacaaggggcccggtacctaagggttagtaaacgttcgggttaaggggacctagggttaacgtttcccaaacttccgtactaaactttacgtacgacggtacctaccgggccttacgggaccttacccgggaaccggtttaacggtaaacggttattttaccgggtttaacgtaaccccgtttaaaactttttaggtttaaaccttaacgggtttaaaaccgtttaaaaaaagtttacctttaaaacccggttaacccttccccggttccccctttaaccgtttaccccggttaaacccggttttaccgggggaacccgggttaacgggggttaaaccctaaagggggttaacgggaaacttacgtaaaacccggaaaccggggttaacttgggggtaaccg

SEQ ID NO: 425857 - DNA, 645 bp, Homo sapiens
  misc_feature: GZ8MTXP01AXMH8.25.4.A04.1.454.CMB.2.raw
  modified_base (284)..(284): a, c, t, g, unknown or other
  modified_base (307)..(307): a, c, t, g, unknown or other
  modified_base (420)..(420): a, c, t, g, unknown or other
  modified_base (466)..(466): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccgagggccggtccctgaccactctcctgcacagtccttccggactcgaccttttggngagcatgctatgaccgtggtccncgaggctaccgaggggtaaggtctggagtcggtcttgggttcagttagaagtcgaagcctagtgggtggacaacacaaagtccgcgtgtctagtaaaaggcagattcagcctntacaagatatagaacttaaccaaaagtccaagtccgactactcgtnacctacgaatcggaacgccgtaaggtacccgtaggaaaggaacggaccggtaagggaaccctccgaaacgggtcccgttaggtttaaaactttcccgttaggttttacctttaacgtttaaccgtcgttaagggtaacggttaggtttaacgggtttaacgtttttaacttttaaaacg

SEQ ID NO: 425858 - DNA, 579 bp, Homo sapiens
  misc_feature: GZ8MTXP01BCDHW.25.4.A04.1.454.CMB.2.raw
  modified_base (324)..(324): a, c, t, g, unknown or other
  modified_base (444)..(444): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacgttggccgggcagtcgagggctattagactaattattagcctggtatacaaacagaaaccgagggagagttacctaagcctcctagactctatcgctcgccctctacgttacnccgtacgacggggtccctagtcgtcggtcaacggcgctagtcgtaagtcgtagggacagtacgttacaccttctactattacacgacgcgacgtccttgacacgtaccggtagaaaggtntacggttacaacttaacctttattaactagttaacgtaaaattactaactcttccgttcccttcttaccgtacggttcgggaccgggacggaccggtaagggtacgaacgttacacgaaacgtcgttggtaaccg

SEQ ID NO: 425859 - DNA, 557 bp, Homo sapiens
  misc_feature: GZ8MTXP01C2Q9B.25.4.A04.1.454.CMB.2.raw
  modified_base (279)..(279): a, c, t, g, unknown or other
  modified_base (361)..(361): a, c, t, g, unknown or other
  modified_base (413)..(413): a, c, t, g, unknown or other
  modified_base (439)..(439): a, c, t, g, unknown or other
  modified_base (455)..(455): a, c, t, g, unknown or other
tcagactgtacagtcacgaccggtgctcgatttagagtagtgatcaggggggctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggaggcttgggtacagccaggccggtccctgacactctcctgcacagcttccggactcaccttggngagcatgctatgacctgggtccgccagggctccgaggggaaggtctggagtggctttgggtcattagaagcgaagccctagnggtggggacaacgaacaaatcgccgcgtactagtaaaggcagattcagcctntcaagagatgattaccaaaagcatcncctattcctgacacanagagacacgcgtagagacgacggaacggacgacgtacgcgtacgttacttacgtttcgtttactttaattacttcgtagtagttagttaagttaagtttaag

SEQ ID NO: 425860 - DNA, 733 bp, Homo sapiens
  misc_feature: GZ8MTXP01DQXNG.25.4.A04.1.454.CMB.2.raw
  modified_base (298)..(298): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaacatggagtttggcttaactgttcttttccttgttgcttagttttaaaaggtgtaccaatgtgaggtgcaacgtgggtggagtcggtggggggaggtcttggtacacgccgacgggtcccggtccctagacctactctcctgcacacgtcttccggactctacgtttggnagcatcgacttagtcggtaccgtggggtcccaccgacggggtcctaccgggaagggggtaacgggttcgtggggtaggttcgggttcgtttgggggttactaaggttaaggaacggcggtaaacgtccgttaggtgggggtacgggaacctaaaaccgaacgtaacggtcccggcccggtacgttaccgtaaaggtaaaacggggctaaaggtacttacgacggtacctacgtaacgaaagtagtaactagtaacttaaccgaaaacgtctaaacgtccgtacgttactcgtacactacgagtgacgacacgtaccgtaggaacggaaggcgaacggttacgtacgttacggttccgttaagtttaacctttcgtttacggttttaactttaaacttccgttcgtaggttaagttaaggtttaagtttttaaccg

SEQ ID NO: 425861 - DNA, 586 bp, Homo sapiens
  misc_feature: GZ8MTXP01CTETD.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgcttgttttaaaaggtgtccaatgtgaggtgcaacgtggtggagtcgtgggggaggcttggtacagccaggcccggtccctgacactctcctgcacagccttccggactctaccgtttggtgagcatgctatcgaccgtgggtcccgccgaggcctccgaggggagggtcgtgggagtggtcgttgggtctagttagagcgaacgtcctagtgggtggggacaaaacgacaatacgccgcgtacgaggtaaaaggcagtattcagtcctctacgaaaggagataggtaacttaaccgaaaagtcaatccgaccgttactccgtcgacaactagtcgagcacgtccgaggagaagcgaaggcctcgacgtccgtgttacgttcttgtttaacttagttctcgttaggagtggttaagttttaagg

SEQ ID NO: 425862 - DNA, 707 bp, Homo sapiens
  misc_feature: GZ8MTXP01CSMAG.25.4.A04.1.454.CMB.2.raw
  modified_base (228)..(228): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgcattctggttaggacgacagaactcagcatcacgttggccgggngagtcgaggctattagactaattatacgcttaggtatacaaacgacgaaacgagggagtacgtttccaaagtcctaccgtagacttctagttcgccctcggtcccctacccgtaacgtttacccgaaccccgtccgggtaccgggttcccctagttccgttacccgggtcaacggcgggactaagggttcgaacgtcgggtagggaacccgtaggttacttacctacgttcctacggtactaacgtcgacgtccgacgtccgtgactacgtaccgtaggtaaaccgttgttacgttacgaaacctttaacttaacgtttaaccgtaaagttaaaccaaaagtttacctaaacccgttccttacccccgaccccttttcgaacccggtttcggttacccgggggaacgggttaacgggaacccggttaagggaaggtaacggtaacctaaccggttaacgttaaccggttggtaacccgg

SEQ ID NO: 425863 - DNA, 676 bp, Homo sapiens
  misc_feature: GZ8MTXP01A2IN8.25.4.A04.1.454.CMB.2.raw
  modified_base (229)..(229): a, c, t, g, unknown or other
  modified_base (433)..(433): a, c, t, g, unknown or other
  modified_base (550)..(550): a, c, t, g, unknown or other
  modified_base (653)..(653): a, c, t, g, unknown or other
tcagactgtacagtcacgaccggtgctcgatttagagtagtgatcagggggcagaagtctctctcagtcaggacacagcatggacatggagggtccctgctcagctcctgggactcctgctgctctggctcccagataccagatgtgacgtccagatcgacccagtcctccactccctccctgtctgctatctgtggagacagaatcagcatctacgtcggcccggggngagtcgagggtctaagttagacttaattattacgccgttaggtaactaccaaacgaacggaaaccgaggggtaactacgttaccctaacggccttaccgtagtaacttctacgtcggcctacgtaccccttaccgtaacggttaccaccccggttaccggtaaccgggggttcccctacggtttcccgttaacccggggttacncgggtacccgggtacgtaaagggttacggtaaacgtttcccggggagggggtaaaccctagggttaccgttacctaccttacgtacctaactaacgtcaacggctaacgccgtgacncgtacggtagaagtcttagtactacttaattataactagtaaactaaattactaactctcccttcctacttcgtaggttcgggacggttcggaacggtaaggngaactagaccgaagtcgttggcg

SEQ ID NO: 425864 - DNA, 721 bp, Homo sapiens
  misc_feature: GZ8MTXP01DJFVV.25.4.A04.1.454.CMB.2.raw
  modified_base (252)..(252): a, c, t, g, unknown or other
tcagactgtacagtcacgaccggtgctcgatttagagtagtgatcaggggctgggagaggagccccagccgtgagattcccaggagtctccacttgttgatcagcactgaacacagaccaccaaccatggagtttggcttaactgtcttttccttgttgcttagttttaaaaggtgtccaatgtgaggtgcaactggtggagtcgtgggggagcttggtacagccaggccgtccctgacactctcctgcacngccttccggactctacctttggtgagcatgctagtcgaccgtgggtcccgccgaggcctaccggaaggggtaacggtcgtgggagtcgggtcgtttggggtttacaagtttaggaacgcgaaacgtccgttaagtcggggtacggggaccaaaccgacgaaaacgttacccggcccgacgttaccgtaaagggtaaaaacggccaaggtacttaccgtacgccttttttaccgacgtaaaggagtaagttagtaacttaaccgaaaacgactaacgtaccgtaccctaacgttccgttacgacaacctagtacgaacgccgacgtacccgtaggaacggaaacggaccggaacgggaaccgtaccgttacggtacccgttaagtttacctttacgtttcgttttactttactttaacttcgttaaggtaagttaggtttaaggtttaacggttttaagtttttaaaccg

SEQ ID NO: 425865 - DNA, 699 bp, Homo sapiens
  misc_feature: GZ8MTXP01BO2QR.25.4.A04.1.454.CMB.2.raw
  modified_base (225)..(225): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatgacccagtcctccatccctccctgtctgcatctggttggagacagaatcagcatcacgttggccgggngagtcgagggctatagctaattattagccgttggtaatacgaaacgaacggaaaaccgagggtaacgtaacgtttacccctaaaggtccctacccgtagtacttcgtaagttcgtccgttcgtacccctaccgtaaccgtttaccaacccgtccggtacgggggtccccctagtttcccggttaaccgggtttcccgaagggtcccgggtacgtaaacggttcggaaaacgttccggtagggggtaaacctaggtaacgtttccaactccttacaacttaactaccgacgtaccacggcccctgacgaaccgggtccgtaaggaaacgttgttagttacgaaccttaaacgttttataacgttagtaaactaaaagtaacttaactaacctccgttacccttcgttccgtaaccggtttcgggacggttacggaacggaaggtcggaataacgaccgaaacgtaacgttggtcg

SEQ ID NO: 425866 - DNA, 634 bp, Homo sapiens
  misc_feature: GZ8MTXP01E5FT3.25.4.A04.1.454.CMB.2.raw
  modified_base (196)..(196): a, c, t, g, unknown or other
  modified_base (223)..(223): a, c, t, g, unknown or other
  modified_base (388)..(388): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatcgtggttgganacagaatcagcatcacgttggccgggnagtcgagggcattagctaattatttagcctggtatacaaacaagaaaccagggagagttaccaagctcctgatctatgctgcctccacgttacacctcgaggggtcccattcgtacggttcaagcggcagttgaatcgtgggacagagttcaactcactattacncacgcacgcagacacgacggtagaagtagttacgtacgtaacttaaacgtttaacgttaacgtaacgttaaacgtaaaacgttaaacttaaccttaacccgttacccgttaccccgttaccgttaccggttaacccggggtttaaccggggaccggggttaaaccggggttaaaccgggtaacggggtaacgggtaaacgtaaacggtaaacccggttaaaaccggttaacggttcgggtaaccgg

SEQ ID NO: 425867 - DNA, 710 bp, Homo sapiens
  misc_feature: GZ8MTXP01AGYKJ.25.4.A04.1.454.CMB.2.raw
  modified_base (229)..(229): a, c, t, g, unknown or other
  modified_base (285)..(285): a, c, t, g, unknown or other
  modified_base (582)..(582): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaacgtggtggagtcgtgggggagcttggtacngccgaggccgtccctgacactctcctgcacacgtcctccggactctaccgtttggngagcatcgctagtcgacccgtgggtcccgccgacgggcctaccggagggggtaacggggtcgtacggggtaggttgggtccgttttgggggttactaagtttaaggaaacggaccggtaacgtcccgttaggttcgggggtacgggggaccctaaaaaacgaaccgtaacggtacccggcccgggtacggttacgtaagggtaaaaacggctaaacggtacttcgacgtccttactaacgaagtagtatagtaacttaaccgaaaagctactccgacttaatcgtacgacacgtagngacgacgacgtccgaagggacgaaacgggcgaaacgggccctacggaccggtacggttacttacgtttacgtttcgtttaactttaactttccgttagtagttaaggttaacgtttaaggtttaacgg

SEQ ID NO: 425868 - DNA, 761 bp, Homo sapiens
  misc_feature: GZ8MTXP01CI7XM.25.4.A04.1.454.CMB.2.raw
  modified_base (194)..(194): a, c, t, g, unknown or other
  modified_base (222)..(222): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttgganacagaatcagcatcacgttcggccgggngagtcgagggctattagactaaattattagccgttaggtaactacaaacgaacggaaaccgaggggagtaacgtttaccctaaaggccttaccgttaggacttaccttaagttcggaccctttcgacccccttacccgtaaccgttttaaccaacccccggtttccggaaccgggggtttcccccagtttcccgttaccggggtttaccaaggggtcccgacgtaagggttacgtaaacgttcccgggtagggggaactacgttaacggtttaccaaccttactacctaaccgttacttaccgaacgtccgaacggtccctacgccgacggtaccgtaggtaaacggtattcggtttactaaccttaaaccgtttaagttacttaaggttaaactaaaacgttaacttaaacctaaccttcccgttaacccccttcttacccggtaaccggtttacggggaccggggttaaacgggttaccgggtaaagggtacgggtaaacgtaacgaaccggttaaaacgtaacgttaacggtccgg

SEQ ID NO: 425869 - DNA, 532 bp, Homo sapiens
  misc_feature: GZ8MTXP01BCJ2Q.25.4.A04.1.454.CMB.2.raw
  modified_base (280)..(280): a, c, t, g, unknown or other
  modified_base (330)..(330): a, c, t, g, unknown or other
  modified_base (466)..(466): a, c, t, g, unknown or other
  modified_base (479)..(479): a, c, t, g, unknown or other
  modified_base (514)..(514): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacagcttccggactcaccgtttggngagcatgctatgacctgggtcccgccaggcctccgaggggaggtctgggngtggcttggggttcagttagaagcgaacgcctagtgggtggggacaaaacacaatcgccgcgtctaggtaaaagcagattcacgcctctacaagagatagacttaccaaaagcaatcgacctatctgacacatgancagcctagagagngagactcagcctgttattcttgttcttattaactntggagtaagttgtttaag

SEQ ID NO: 425870 - DNA, 677 bp, Homo sapiens
  misc_feature: GZ8MTXP01A7EQK.25.4.A04.1.454.CMB.2.raw
  modified_base (195)..(195): a, c, t, g, unknown or other
  modified_base (222)..(222): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttgganacagaatcagcatcacgttggccgggngagtcgagggcattagactaattattagctaggtatacaaacaacgaaaccgagggagtacgttaccaagtcctctgactctatgctcgcctacctacgttaccaccgtccgagggtcccctagttcccgtcgggttacaacgggccggacgtaagggtacgtaaacgttcgggtacgggtactaacgggtactttaccacttctacctaacttacttaccgtagaccacgccgtcggactaccggccggtaagtaaacggtgtttaacggttataaacccgtttaatttaacgtttaaaccgttaaggttaaaacctaaaaagtttaccttaaacggttaacccttccgttaccccgttacttccggtaaccgtttaccgggggacggggttaacgggttacccgtaaaggggttcggaaacgttacgtaaccgaaacggtcgttaagggtccg

SEQ ID NO: 425871 - DNA, 545 bp, Homo sapiens
  misc_feature: GZ8MTXP01BLAD2.25.4.A04.1.454.CMB.2.raw
  modified_base (275)..(275): a, c, t, g, unknown or other
  modified_base (299)..(299): a, c, t, g, unknown or other
  modified_base (353)..(353): a, c, t, g, unknown or other
  modified_base (450)..(450): a, c, t, g, unknown or other
  modified_base (452)..(452): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactggtggagtcgtgggggagcttggtacagccaggccggtccctgacactctcctgcacagcttccggactcacctttggngagcatgctatcgacctgggtccncaggctcgagggaggtctggagtggtcttgggtcagttagagcgaacgcctagngggtgggacaaaacgacaagtaccgccgcgtctaggtaaaaggcaagattcagcctctacaagagatagacttaccaaagcatcgcctatctgacangngagacacgcaggacgagaacggtacgactcgacgtcgtagttacgttcttacgtttaactttagtaacgttgtagttagtaagttaagttaag

SEQ ID NO: 425872 - DNA, 613 bp, Homo sapiens
  misc_feature: GZ8MTXP01A6XSV.25.4.A04.1.454.CMB.2.raw
  modified_base (286)..(286): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccgaggccggtcctgacactctcctgcacagtccttccggactctacctttggtnagcatgctatcgacctgggtcccgcaggcctccgaggggaggtctgggagtggcgtttgggtcagttagagcgaacgcctagtggtagggacaaaacgacaataccggccgtacgtacgtagtaaaagggcaagtattcgagtcctactacgaaagagatagtaacttaacccgaaaagtcaactccgaccttatcgtcaccacagtgacggacaacgccgtaggaagaacggaaccggaaggacctaccgaggtcccgttaggttaactttcgttcggtttaaccttacttaacttccgtaggttaagtggtttaaggttttaagg

SEQ ID NO: 425873 - DNA, 667 bp, Homo sapiens
  misc_feature: GZ8MTXP01D2RTG.25.4.A04.1.454.CMB.2.raw
  modified_base (219)..(219): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcaggcattagctaattattagccttggtaatacgaaacaaggaaaccgagggaagtacgttacctaaaggccttcctagtacttctaatcggtctcgcccttaccgacgtttacacccgtaccgtacggggtcccctaagttcccgtaaccggggtttacaacgggccggtacctagggttacgtaacgtcggttagggggaacctaggtacgttccaactcctactaactaactcgacgcacggttccacgacgacgtacggtacgtaagtagttacgttacgtacgttaactttaacttaacttaacgttaaacgtaaagttaaacttaacttaacttaccgttacccttaccgttaccgttaccggttacgggttacgggttacgggttaacggtaacgggtaaggtaacgtaacgtaacgttaacgtaacgttaacgtcg

SEQ ID NO: 425874 - DNA, 750 bp, Homo sapiens
  misc_feature: GZ8MTXP01B4ANU.25.4.A04.1.454.CMB.2.raw
  modified_base (231)..(231): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatcgacccagtcctccatccctccctgtctgctattcgtggttggagacaagaatcagcatcacgttcggccgggngaggtcgagggctagttagacttaattattacgccttaggtactacgaaacgaaggaaaccgaggggaacgtacgtttacctaaacgtccttaccgtgtacttcgtactcgtcctccgtccctccgtaacgttacctaccccgtccggtacgggggttacccctagttcccggttacccgggttcaacggggtccgtaacgtagggttacgtaacgttccgggtaggggaactaggtacttccctaactctacctaactttacgccaaagccgaacgcccgttacgggacctaaccgggtaccgttaaggaaagtttcgttacgggtttactaacccttaaagttttattaaccgtaaaggtttaaacctaaaaagtttaaccttaaccgttaaccgttcccgttcccccttcggttaaccgtaccgggtttaccgggggaaccggggaccgggttaacggtaacggggtagggtaaaccgaagttaacccggaaacgggttaacttggggttaacccg

SEQ ID NO: 425875 - DNA, 662 bp, Homo sapiens
  misc_feature: GZ8MTXP01BGH8Q.25.4.A04.1.454.CMB.2.raw
  modified_base (201)..(201): a, c, t, g, unknown or other
  modified_base (232)..(232): a, c, t, g, unknown or other
  modified_base (276)..(276): a, c, t, g, unknown or other
  modified_base (292)..(292): a, c, t, g, unknown or other
  modified_base (346)..(346): a, c, t, g, unknown or other
  modified_base (497)..(497): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatcgacccagtcctccatccctccctgtctgctatcgtgttggaanacaagtaatcagcatctacgttcggccgggngagtcgagggtactagttagactaattattacgccttaggtaanacaaacgagaaaccgnggtatacgttccaagtcctactgattctagtcgcctacgccctacacgttaccnccgtccggacggtccctagtccggtaacgggtcaacggtcggtacgtaggtacgtacgtcgggtacgggtaactacgtacgttccaaccgttctacaaacttcgtacctacggccgtacgcctacgactacggtacgttaagaaacggttnttacgttacgtaaactttaactttagttaacgtaaacgtaaactaaagttaaccttaaccgtccttcccgttccccttacgttacccggttaacggggtaccggggaacgggttacggaacgggtaaggcgtaacgtaacgaacggttaacgtcgttggtaaccg

SEQ ID NO: 425876 - DNA, 705 bp, Homo sapiens
  misc_feature: GZ8MTXP01EXRV8.25.4.A04.1.454.CMB.2.raw
  modified_base (197)..(197): a, c, t, g, unknown or other
  modified_base (225)..(225): a, c, t, g, unknown or other
  modified_base (399)..(399): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctccctgtctgcatctgtgganacagaatcagcatcacgttcggccgggngagtcgaggctatagactaaattattagccgttaggtaataccgaaaacgaacggaaaaccgaggggtataacggtttaccctaaaggtcctaccgtagtacttactaagtcggtcctccgtccctacctaccggttaccaccgtccggacgggtccctagtccgtcggttacnggccggtataagggtcgtaaacgtcggacggggtaactacgtacgttacctaccttctaacccagtttaacctacgacgaccgacgtccgtagaccgtacggtacggtaagtaacgttacgttacgtaacgttaactttaaacgtttaacgttaactaagttaaaaccttaaagttaacttaacctaacccgttcccgttaccccgttacgttaacccggttaccgggttacggggaacgggttaccgggaacggtaagggtacgtaacgtaacgtaaccggttaaacgttcggttaaggtaaccg

SEQ ID NO: 425877 - DNA, 698 bp, Homo sapiens
  misc_feature: GZ8MTXP01DAZ5Y.25.4.A04.1.454.CMB.2.raw
  modified_base (221)..(221): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttagagacagaatcagcatcacgttggccgggngagtcgagggcattagactaattattagcctaggtaatacaaacaaggaaaccgagggaatacggttacctaaacggccttaccgtagacttacctagttcggccttacggaccccttacccgtaaaccgtttaacctaccccgttacccggacgggggttacccctaagttccggttaccgggttcgaacgggccggtaccgtaaggtacgtaacgtcggtaggggaacctagtacgttcaccttctacctaactactccgagccaacgccctggaccgtagacccgtaagggtaagtattacggttataaccttaaaccgtttaatttaacgtacgttaaacttaaaagttaacttaaaccgttaaccgtaccgttaccccttacgttaccgtttaaccggtttcgggggaacgggttacggaaaccggtaaggggttacgaaacggtactaaccgaaacgtcgttcggtaacgg

SEQ ID NO: 425878 - DNA, 698 bp, Homo sapiens
  misc_feature: GZ8MTXP01CBNX8.25.4.A04.1.454.CMB.2.raw
  modified_base (283)..(283): a, c, t, g, unknown or other
  modified_base (585)..(585): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttctttttccttgttgtcttagttttaaaaggtgtccaatgtgaggtgcaacgtggtggagtcgtgggggagcttggtacagccaggcccgtcctgacactctcctgcacagccttcccggacttctaccgtttggngagcatgacttagtcgaccgtcgggtcccgcgaggcctaccggagggaggtcgtcggtaggtcggtcggtttggtttacgtagttaggaacggacgtaacggtaccgtaccggttggggtacggggtacaaaccgaaccgtaaaacgtaacccgtccggccggttaacgttaacggtaaaacgggtacgtacgtaacgttcgtacccgtcgtacctacgaaagtaagtaagtaacgtaacttaaacgtaaacgaccgtactaccgccttactcgttagaccaactgacgcgacgagtaccgngtaagaacggaccggagtaaccgtcgttacgtcggttcgttaacttcgtttacgtttcgtttaccttaacgttcttaagtaggtaggtttagtttaaggtttaacttttaacg

SEQ ID NO: 425879 - DNA, 674 bp, Homo sapiens
  misc_feature: GZ8MTXP01DNVTY.25.4.A04.1.454.CMB.2.raw
  modified_base (282)..(282): a, c, t, g, unknown or other
  modified_base (307)..(307): a, c, t, g, unknown or other
  modified_base (462)..(462): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaacatggagtttggcttaactgttcttttccttgttgtcttagttttaaaaggtgtccaatgtgaggtgcaagtggtggagtcgtgggggagtcttggtacagccaggccgtcctgacactctcctgcacacgtccttccggactcgtacttggtnagcatgctagtcgacctgggtcccncgaggcctaccgagggggaacggtctggaggttggcgtttggggttactagttaaggaagcgaaacgtccgtagtgggtaggggaccaaaaacgaactaacgtaccggcccgtacggtactaaggtaaaacgggcaagattccgacgtcccttanaagaagaagtactaagtaactaaaccgaaacgacctaacgtccgtacttacgtcgtacgacaatagtcgacgaccgtaacggtaccgtaaggaacggaaacggaacggtaaacgttaccgtacgacggttaccgttaagtttaaccgtttcgttacgttttaactttaacgtttccgtagttaggttaagtttaacgtttaagggttttaag

SEQ ID NO: 425880 - DNA, 576 bp, Homo sapiens
  misc_feature: GZ8MTXP01AVGCL.25.4.A04.1.454.CMB.2.raw
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccaggccggtccctgacactctcctgcacagcttccggactcacctttggtgagcatgctatgacctggtcccgcaggctccgaggggaggtctgggagtggtcgtttgggttacagttaggaagcgaagcctagtgggtagggacaaaacacaatcgccgtacgtctaggtaaaagcagtattcacgtcctactacaagagtatagacttacaaaagcatccgactatctagactaacagtgacgacagcctaggaacggaaggaaccggaaggactacgacggtaccgtagttactttccttgtttaacttattaacctgtaggttagtaagttaaggtttaag

SEQ ID NO: 425881 - DNA, 669 bp, Homo sapiens
  misc_feature: GZ8MTXP01BBLTI.25.4.A04.1.454.CMB.2.raw
  modified_base (199)..(199): a, c, t, g, unknown or other
  modified_base (410)..(410): a, c, t, g, unknown or other
  modified_base (479)..(479): a, c, t, g, unknown or other
  modified_base (502)..(502): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgctatctggttgganacagaatcagcatctacgttcggccgggacgagtcgagggctagttagactaattagttacgccgttaggtaactaaccgaaacgaacggaaaaccgaggggtaacgtacgttaccctaaaggtcccttaccgtagtacttacgtacgtcgtcctacgtccctaccgtacgttacctacccgtacggtacggtccctagtcgtacggtacncggcgactagtacgtacgtcggtagggactagtacttcacctctactaactctacgacgacgacgtccncgactacgacgtaaggtaacgtnttcggtactaaccgttaaactttattaaaccgtagtaaaacttaaaacgttacttaaaccgtccgtacccttcccgttacgttaccgtaaccggggttacgggaccggggttaacggaaccggtaagggtcgaacgtaacgaaaccgttaaacggtgttcggtaacg

SEQ ID NO: 425882 - DNA, 738 bp, Homo sapiens
  misc_feature: GZ8MTXP01AT8IB.25.4.A04.1.454.CMB.2.raw
  modified_base (227)..(227): a, c, t, g, unknown or other
  modified_base (571)..(571): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctcccagataccagatgtgacgtccagatcgacccagtcctccatccctccctgtctgcatcgtgttggagacagaatcagcatctacgttggccgggngagtcgagggctaagttagactaattagttacgccttaggtactacaaacgaacggaaaccgaggggaacgtacgttacctaacggtccttaccgtagtacttccgtaagttcggtaccgtccgtaccccgttaacccgttaaccgtttaacccgaacccccggtttaccgggtaaccgggggtaccccttaacgttcccggttaacccggggttaccgccggggccggtaacgtaacgggtacgtaaacggttcggtacgggggtaacctagggttacgttaccctacttcctactaacgtactacacgcctacgcctgactacggtacgtaggtaaacgttnttcgggttaactaacttaaaccgttttaataaccgttaagtaaactaaaagttacttaaccgtaacttcccgttacccctgttcccggttaacggttcggggaacgggacggttaaccggtaagggtaggaacgttaacgacgttaaacggtaacgttcgggtaacg

SEQ ID NO: 425883 - DNA, 806 bp, Homo sapiens
  misc_feature: GZ8MTXP01A90CO.25.4.A04.1.454.CMB.2.raw
  modified_base (528)..(528): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgtgccggagagtcgagggcagttaacgctaaattagtttacgccgttaggtaactaccgaaacgaacggaaaacccgtaggggaaacgtacggtttacccctaaaggccctttaccctaggtaacttcctaagttcggtccttacggccccctttaaccgaaccggtttaacctaacccccggttaccggtaaaccggggggtttccccctaacgtttcccgttaaccggggtttccgaacgggcccggggtaccttaaagggtacgtaaacgttcccgggttaggggtaaacgaacggtaacgtttacctaaccttntacccccccctaagttaaacctaccgacgtaccgacgtccgtacgacgtacgtaccggtacggtaagtacgttacgttacgtaacgttaacttaacgttaacgttaacgttaaacgttaaaacgttaaacttaaacttaaccgttacccgttaccccgttacccgttacccgttaccgggtttaccgggttaaccggggttaaccggggttaaccgggtaacgggtaacgggtaacggtaaacgtaaaccggttaaacgtaacggttaacggtaacgg

SEQ ID NO: 425884 - DNA, 814 bp, Homo sapiens
  misc_feature: GZ8MTXP01EMYQO.25.4.A04.1.454.CMB.2.raw
  modified_base (196)..(196): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactcctccctgtctgctatctgtganacagaatcagcatcacgtcggccgggcgagtacgagggtactagttaagactaattagttagccttaggtaactacgaaacgaacggaaaaccggtagggacgtacgtttacccgtaagtcctaccgtagtacttctaacgtcgtccttaccggtaccctacccgtaaacgtttaaccaaccccgttaccggtaaccggggtacccctaagttcccgttaaccgggttaccgaacgggccggtaacgtaacgggttacgtaaaccggtttcgggtaaacggggtaactaacggggttaccctttaccaacccgttcctaacctaacttaacgtacgaacggtaccacccgtacgttacgaccgtaaccgtaccggggttaaggaacggttattacgggtttaaccgaactttaaacctttaaacggttaacttaaaccggtaaaagttaaaaccttaaacttaaacccttaaccggttccccttaccccttacgtttacccggtaacgggttttacccggggaaacgggggaaccgttaaaccgggtaaaggggtaacggggaaacctttaaaccggaaaccgggttaaaacggttaacccgttcgggggtaacccgg

SEQ ID NO: 425885 - DNA, 836 bp, Homo sapiens
  misc_feature: GZ8MTXP01AUXOB.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgctatctgttggagacagaatcagcatcacttggccgggngagtcgagggcaattagctaaatattagccttggtaactcaaacgaagtaaaccaggggtaagtacgtttacctaaaggccttacccgtaggtacttcgtaattcggccttaccggtcccctacctaaaccggtttacctaccccccgttccggtaaacgggggttccccctaagttccccgtttaccgggttaccgaacggggtcccgggtaccgtaacgggtttacgggaaacgtttccccgggtaagggggtaaaccgttaacgggtaacgggttttacctaaacccgttccgtttaacccgtaaccttaaacggttacccgtaaacggacccgtaaccggttccccgttaagggacccgtaacgggtaccccggttaaggggtaaaaccggttagttaacgggtttaccggtaaacccttaaaccgtttaaacttaaccgtttacgttaaaaccgtaaaaaggttaaccttaaaacgttaacccgttacgttcccccgtttacttacccgttaaccgggtttaccgggaacggggttaccgggttaaaccggtaacggggtggtaaacggtaccgtaacgttaaaaccgggtaacgtttggtaaccggg

SEQ ID NO: 425886 - DNA, 772 bp, Homo sapiens
  misc_feature: GZ8MTXP01DBDB9.25.4.A04.1.454.CMB.2.raw
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgttctttttccttgttagcttagttttaaaaggtgtccaatgtgaggtgcaacgtggtggagtcgtggggggagtcttgggtacagccgagggcccggtccctgacactctcctgcacagccttcccggactctaccgtttggtgacgcatcgctatcggaccgtcggggtcccgaccgaggcctaccggagggggtaacgggtcgtagggaggttcgggtacgttttgggggttactaagttaaggaacggacgtaaacggtcccccgtaaggtacgggggtcggggaaaccaaacgaaaccgtaaacgttccccgggcccggtaccggttaacgtaacgggtaaaaaacggcgtaaaggtactttaccgaacggtcccttactacgaaaggaagtaagttacgtaacttaaaccccgaaaaagcctaaacggtccgtaccccttaagttcccgtacggtaccaaaccagttacgggactaccgaaacggtccctaaggaaaccggaaaggtacgggaaacgggtaaccttcggtaacggttacccggtttattaaccgttttactttggtttacctttaaacttaccttgtagtagttaaggttaagtttaaggttttaaacc

SEQ ID NO: 425887 - DNA, 660 bp, Homo sapiens
  misc_feature: GZ8MTXP01DSQWJ.25.4.A04.1.454.CMB.2.raw
  modified_base (194)..(194): a, c, t, g, unknown or other
  modified_base (196)..(196): a, c, t, g, unknown or other
  modified_base (490)..(490): a, c, t, g, unknown or other
  modified_base (501)..(501): a, c, t, g, unknown or other
  modified_base (509)..(509): a, c, t, g, unknown or other
tcagactgtacagtcacgaccggtgctcgatttagagtagtgatcaggggggcagaagtctctctcagtcaggacacagcatggacatgagggtccctgctcagctcctgggactcctgctgctctggctccagataccagatgtgacgtcagatgacccagtctccatccctcctgtctgcatctggttggananagaatcagctatcacgttgggccgggacgtagtacgaggggtactaagttacgtactaaatttacgttaacgcccgttaggtaaactaacgaaaacgaaacggaaaaccgaggggtaaacgtacgtttaccaaaggtcctaccgttagacttctattcggccgttactaccctaccgtaacgttaccgtaaccggtccggtacgggttacccagttccggtcggttacgaacgggcgggtaaactaggtctaaagtccgggtaaaggacctaggtacttccactctaacgactnacagccgtacncgacgacncgtaacggtagtaagtctagttactaacttaattacgttaacgtaagtaaataaatacttaacctctcccttcctacgttacgtacgggtacggggaacgggttaacgaacggtaaggtacgaacgtaactaaccggaagtgttcggtaac

SEQ ID NO: 425888 - DNA, 577 bp, Homo sapiens
  misc_feature: GZ8MTXP01BAO3S.25.4.A04.1.454.CMB.2.raw
  modified_base (195)..(195): a, c, t, g, unknown or other
  modified_base (222)..(222): a, c, t, g, unknown or other
  modified_base (245)..(245): a, c, t, g, unknown or other
  modified_base (461)..(461): a, c, t, g, unknown or other
  modified_base (466)..(466): a, c, t, g, unknown or other
tcagactgtacagtcacgaccggtgctcgatttagagtagtgatcgagggggcagaagtctctctcagtcaggacacagcatggacatgagggtccctgctcagctcctgggactcctgctgctctggctcccagataccagatgtgacgtccagatgacccagtcctccatcctcctgtctgcatctgttgganacagaatcagcatcacgttggccgggnagtcagggctagttagctaattnttacgccttggtaactaccaaagaacgaaaccgtaaggggatacgttttacccgaaagtcgtaccctaggtattcctaagttcggcctcggtccctaccgtaaacgtttaccaacccgtccgaacgggggttcccaagttccgtaccgggttcaaggcccgggataggttcaaagtccgtaggggactagtaacgttccactctacagtatcgacncatcngcgcgacgtagtagtagtgtctactactatactactataatactataactcttcctcttcgtcgtacggttacggcgacgaaggtagaacgacgacgacgtaacgttgtcg

SEQ ID NO: 425889 - DNA, 722 bp, Homo sapiens
  misc_feature: GZ8MTXP01B4GHH.25.4.A04.1.454.CMB.2.raw
  modified_base (246)..(246): a, c, t, g, unknown or other
  modified_base (281)..(281): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaacgtggtggagtcgtgggggagcttggtacagccaggccggtccctgacnctctcctgcacagccttccggactctacctttggngagcatgctagtcgaccgtgggtcccgccgaggccctccggaagggggtaacggttcgtggggaggttcgggtcgtttgggggtttacaagtttaaggaaggtccgtaaacggcccgttaaggtggggtacgggggaccaaaaacgaaccaacggttaccgggccccgtcggttacgtaaggaaaaacgggcaaagtacgtttacgaacggtccctacgtacgaaagtaaggaacttaggtaaacttaaccggaaaaaacgtcgtaacgttacccgtaccgttacgtacgtacgaaccgtacgtacgtacggacgtaccgaaccgtaccgtaaggaacggaacggtaacggaacggttaccgtacgttacggtaccgttagtttacgtttacgttgtttaactttacgttaacgtgtagttagttaaggtttaacgttaag

SEQ ID NO: 425890 - DNA, 774 bp, Homo sapiens
  misc_feature: GZ8MTXP01BPS04.25.4.A04.1.454.CMB.2.raw
  modified_base (193)..(193): a, c, t, g, unknown or other
  modified_base (218)..(218): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctttggcctccagataccagatgtgacgtccagatcgacccagtctccatccctcctgtctgcatctgtganacagatcagcatcacgttggccggngagtcgagggctatagctaattattagcctggtactacaaacaagaaaccgagggagtacgttacctaacgtctcctgtatctatcgaccttcgcccttaccgtaacgttaccacgttcccgacgggggtaccctagttccgtccgggtttaaccaacgggcgggtactaagggttacgaaacgttcggtaggggaacgtacggttacgttacctaaccttctacctaacttactacgacgacgcgtacctcgaccgaaacgtcccgttaaggggtaaacgttacgtttacgggttacgtaaaccgtttaaaccgtttaactttaaccgttaaacggtttaaaccttaaaaaaggtttaaacctttaaaacgttaacccttaaccccggttaaccccctttaccgttaacccggttaacccggttttaacccgggggaacccggggttaaaccgggggttaaccgttaaaacggggggtttaacgggaaaacccgttaaacggtaaacccggtaaaaccggttaaaccgggttcggtttaaccggggttaaccccg

SEQ ID NO: 425891 - DNA, 776 bp, Homo sapiens
  misc_feature: GZ8MTXP02ISPDT.25.4.A04.1.454.CMB.2.raw
  modified_base (178)..(178): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctcccgtntgcatctgttggtaggacagaatacagacatcactgtccgggccggagtcagggcgatagtacaatatttagcctggtatcaacaagaaaccgaaacggaggagttaccttaacgactcctacgatacctatgtctcgtcctacctaccgttaacctacctacccgtacggggtccccgtaacctcgttcccgggtttaccgtaacgcgggggtcccaacggttagggtaattaacccgttgggggaaaccgtaacggaaaggttttccaacccttcctttaccaacccttaaaatttcccaaagggaccaacggacccctttcggccaaacgggccccctttacggaaaaggggttaaacttggtttttacgggaaaccaaacccgtttaaaaagttttcccggggttaagtaccgttaaaaaaaaacgttaatttaaaacttaaaaccgtttcccccgtacccccttacctttacccgttaaaccgggttttaccgggggtaccgggggaaaaccgggtaaaccggtaaaacggggtaaggggttaaacgaaaaccgttaaccgaaaaaccggtaaaccggttagggtttcggacg

SEQ ID NO: 425892 - DNA, 485 bp, Homo sapiens
  misc_feature: GZ8MTXP02JF4NV.25.4.A04.1.454.CMB.2.raw
  modified_base (330)..(330): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacacctcaggggtccatctcggttcngcggcagtgaatcgtgggacagagttcactctcactatcagcagcctgcagcctgaagatgttagctaacttattactgtacaaaagtataataactgccctctcaactttcggacggaggaccaaggtggaagacgtacaaacgaactgtacgg

SEQ ID NO: 425893 - DNA, 482 bp, Homo sapiens
  misc_feature: GZ8MTXP02HIZZQ.25.4.A04.1.454.CMB.2.raw
  modified_base (268)..(268): a, c, t, g, unknown or other
  modified_base (329)..(329): a, c, t, g, unknown or other
  modified_base (379)..(379): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattattagcctggtatcaacagaaaccaggganagttcctaagctcctgatctatgctgcctcacgttacacctcaggggtcccatctcgttcngcggcagtgaatcgtggggacagtagttcactctcactatcagcagcctncagcctgagatgtgtctaactattatatataaataataataactacaccctctctacttacgtcggacggaccgaaggtaggacgagacaacgaacgtagtgg

SEQ ID NO: 425894 - DNA, 485 bp, Homo sapiens
  misc_feature: GZ8MTXP02HWFJ9.25.4.A04.1.454.CMB.2.raw
  modified_base (330)..(330): a, c, t, g, unknown or other
  modified_base (404)..(404): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgctccagttacacctcaggggtcccatctcggttcngcggcagtgaatctgggacagagttcactctcactatcagcagcctgcagcctgaagatgttgcaactattacngttacaaaagtataaatactagtacccctctctaactttcggacggtagggaccaaggtgagactacaaaacgactagtgg

SEQ ID NO: 425895 - DNA, 484 bp, Homo sapiens
  misc_feature: GZ8MTXP02FX48D.25.4.A04.1.454.CMB.2.raw
  modified_base (329)..(329): a, c, t, g, unknown or other
  modified_base (396)..(396): a, c, t, g, unknown or other
  modified_base (431)..(431): a, c, t, g, unknown or other
  modified_base (480)..(480): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggcgagtcagggcattagcaattatttagcctggtatcaaacagaaaccagggagagttcctaaagctcctgatctatgctgcctcacgttacactcagggtcccatctcgttcngcgcagtgaatctggggacagagttcactctcactatcagcagcctgacagcctagaagatggttanacctaattattactgtacaaaagtataaataactntcccctctcactttcggacgaggtaccaaggtgagactacaaacgaacngtag

SEQ ID NO: 425896 - DNA, 513 bp, Homo sapiens
  misc_feature: GZ8MTXP02JPC5B.25.4.A04.1.454.CMB.2.raw
  modified_base (494)..(494): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggccggtccctgacactctcctgcacagcttccggactcacctttggtgagcatgctatgacctgggtccgccaggctccagggaggtctggagtggcttgggttcattagaagcgaagcctagtgggtggggcaacacaatacgccgcgtctgtaaaaggcagattcagcctctcaagagatgacttaccaaaagcatcgcctatcctgcacatgagcagcctgagaagcgaggactcgagccgtgtactactgttcttataactntagagtagtagtagttata

SEQ ID NO: 425897 - DNA, 484 bp, Homo sapiens
  misc_feature: GZ8MTXP02GPF6H.25.4.A04.1.454.CMB.2.raw
  modified_base (331)..(331): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccagggagagttcctaaagctcctgatctatgctgcctcacgttacacctcaggggtccatctcggttcngcgcagtgaatctgggacagagttcactctcactatcagcagcctgcagcctgaagatgttgactaacttattactgtacaaaagtataatactcgccctctcactttcgacggagggaccaaggtcgaagactacgaaaacgaacgtgtagg

SEQ ID NO: 425898 - DNA, 524 bp, Homo sapiens
  misc_feature: GZ8MTXP02GEUZH.25.4.A04.1.454.CMB.2.raw
  modified_base (479)..(479): a, c, t, g, unknown or other
  modified_base (506)..(506): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactctaccttggtgagcatgctatgaccgtgggtcccgccaggctccgaggggaagggtcgtggagtggcgttggggttcattagaagcgaagcccctagtgggtggggacaacacaatccgccgcgtctagtaaaagcagattcagccctctacaagagatgaacttaccaaaagcaatccgctatctgcacatgagcagctgagagcgagctnacgcgtgtacttctgttcttaattctntgagtagtgttagtttaa

SEQ ID NO: 425899 - DNA, 512 bp, Homo sapiens
  misc_feature: GZ8MTXP02IKT7P.25.4.A04.1.454.CMB.2.raw
  modified_base (222)..(222): a, c, t, g, unknown or other
  modified_base (341)..(341): a, c, t, g, unknown or other
  modified_base (363)..(363): a, c, t, g, unknown or other
  modified_base (377)..(377): a, c, t, g, unknown or other
  modified_base (386)..(386): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgaccccagtcctccatccctcctgtctgcatctgttggagacagaatcagcatcacttggccgggngagtcagggcattagcaatttattagcctggtatacaaacagaaaccagggagagttacctaagctcctgatctatgctgcctccacgttacacctcgacggggtcccatctcggttcngcgcagtgaatcgtgggacagntcactctcactacncagcacgcncgcgacgacgtagtagtagttagtagtactaacttaacttactataataaataataactactactcctctactacgtacggacggacggacgaaggtaggacgacgtaacgaacgtacgtacgtcg

SEQ ID NO: 425900 - DNA, 539 bp, Homo sapiens
  misc_feature: GZ8MTXP02HDTMT.25.4.A04.1.454.CMB.2.raw
  modified_base (274)..(274): a, c, t, g, unknown or other
  modified_base (296)..(296): a, c, t, g, unknown or other
  modified_base (317)..(317): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggnagcatgctatgacctgggtccnccaggcctccgagggaggtcnggagtggctttggggtcattagaagcgaagcctagtgggtggggacaaacgacaaagttccgccgcgtctaggtaaaagcaggattcagcctctcaagagatgattaccaaaagcaatcgacctatctgacacatgagcagcctagagaagcgaggactcgaagcccgtagtacgttactgtttacttagttaactcgtagagtagttagtggttatttaac

SEQ ID NO: 425901 - DNA, 479 bp, Homo sapiens
  misc_feature: GZ8MTXP02GN242.25.4.A04.1.454.CMB.2.raw
  modified_base (218)..(218): a, c, t, g, unknown or other
  modified_base (329)..(329): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggngagtcagggcattagcaattattagcctggtatcaacagaaaccagggagagttcctaagctcctgatctatgctgcctcacgttacacctcagggtcccatctcggttcngcgcagtgaatctgggacagagttcactctcactatcagcagcctgcagcctgaagatgttgactaacttattactgtacaaaagtataatactcgccctctctactttcggacggtaggaccaaggtggagatacaaacgacgtgtcgg

SEQ ID NO: 425902 - DNA, 518 bp, Homo sapiens
  misc_feature: GZ8MTXP02H8Q6Y.25.4.A04.1.454.CMB.2.raw
  modified_base (334)..(334): a, c, t, g, unknown or other
  modified_base (346)..(346): a, c, t, g, unknown or other
  modified_base (369)..(369): a, c, t, g, unknown or other
  modified_base (373)..(373): a, c, t, g, unknown or other
  modified_base (380)..(380): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggcagtcagggcattagcaattattagcctggtatcaaacaagaaaccgagggagagtttccaaagctactgatctatgctgcctcacgttacacctcagggtcccatctcgttcagngcagtgaatcgngggacagtgtacactctcactanacancacgctncacgacgtagaagatagtagtactaacttaatactataataaagtaaataaactactactacctacctacgtacgttaccggtacggaacggaacggtaacggtacggaacgacgtaacgaaacgtaacgtacgtacg

SEQ ID NO: 425903 - DNA, 494 bp, Homo sapiens
  misc_feature: GZ8MTXP02FLIT1.25.4.A04.1.454.CMB.2.raw
  modified_base (366)..(366): a, c, t, g, unknown or other
  modified_base (371)..(371): a, c, t, g, unknown or other
  modified_base (374)..(374): a, c, t, g, unknown or other
  modified_base (394)..(394): a, c, t, g, unknown or other
  modified_base (400)..(400): a, c, t, g, unknown or other
  modified_base (435)..(435): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccggcgagtcagggcattagcaattatttagcctggtatcaacagaaaccagggagagttcctaaagctcctgatctatgctgcctccacgttacacctcacggggtcccatctcggttcagtcggcagtgaatctgggacagagttcactctnactancancacgctgcacgctagaagtnttgtanactaattatactagtaataaaagtataactactcnccctactcgtacgttcggacggacggacgaaggtgaacgactaacaaacgtacgtgtcg

SEQ ID NO: 425904 - DNA, 484 bp, Homo sapiens
  misc_feature: GZ8MTXP02H7V12.25.4.A04.1.454.CMB.2.raw
  modified_base (436)..(436): a, c, t, g, unknown or other
tcagactgtacagtcacgaccggtgctcgatttagagtagtgatcagggggcagaagtctctctcagtcaggacacagcatggacattagggtccctgctcagctcctgggactcctgctgctctggctcccagataccagatgtgacgtccagatgacccagtctccatcctccctgtctgcatctgttggagacagaatcagcatcacttgccgggcagtcagggcattagcaatatttagcctggtatcaacagaaaccagggagagttcctaagctcctgatctatgctgcctccacgttacactccaggggtcccatctcgttcagtcgcagtgaatctggggacagagttcactctcactatcagcagcctgcagcctgagtatgttagctaacttatactagtacaaaagtataataactcaccccttntcactttcggacgacggaccaaggtgagatacaaaacgactagtggac

SEQ ID NO: 425905 - DNA, 539 bp, Homo sapiens
  misc_feature: GZ8MTXP02HBIIP.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacagcttccggactcacctttggtgagcatgctatgacctgggtccgtcaggctccgaggggaggtcgtggagtgggcttgggttcagttagaagtcgaacgcctagtgggtggggacaacacagtaccgccgcgtctaggtaaaaggcaagtattcagcctctacaagagatgaacttaaccaaaagcaatccgacctatctgccaacatgagcagcctagagagcgaggctcgacgcgtagtactacttgttaacttattactcgtagagtagttagtttag

SEQ ID NO: 425906 - DNA, 515 bp, Homo sapiens
  misc_feature: GZ8MTXP02GNYKD.25.4.A04.1.454.CMB.2.raw
  modified_base (372)..(372): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttggtacagccaggccggtccctgacactctcctgcacagcttccggactcaccttggtgagcatgctatgacctgggtccgccagggctccgaggggaaggtctgggagtgggcttggggttcattagaagcgaagcctatggtggggcaacanatacgccgcgtcagtaaaaggcagattcagcctctcaagagatgattaccaaaagcaatcgacctatctgcacatgagcagcctgagaagcgaggactcagccgtgtacttactgttctacttactctagagtagtagtttag

SEQ ID NO: 425907 - DNA, 530 bp, Homo sapiens
  misc_feature: GZ8MTXP02HW6F8.25.4.A04.1.454.CMB.2.raw
  modified_base (248)..(248): a, c, t, g, unknown or other
  modified_base (297)..(297): a, c, t, g, unknown or other
  modified_base (320)..(320): a, c, t, g, unknown or other
  modified_base (381)..(381): a, c, t, g, unknown or other
  modified_base (407)..(407): a, c, t, g, unknown or other
  modified_base (437)..(437): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggcccggtccctgacactctccngcacagcttccggactcacctttggtgagcatgctatgacctgggtccnccaggcctccgaggggaaggtcnggagtggcttggggttcattagaagcgaagcctagtgggtggggcaacgacaatacgccgngtctagtaaaaggcagattcagcctntacaagagatgataccaaaagcatcgctanctgcacatgagcagcctagacgaagcgaaggactcgagccgtatacgttactgttacttattaacctgtagtagtagttagtagtttattaac

SEQ ID NO: 425908 - DNA, 504 bp, Homo sapiens
  misc_feature: GZ8MTXP02F24A2.25.4.A04.1.454.CMB.2.raw
  modified_base (327)..(327): a, c, t, g, unknown or other
  modified_base (351)..(351): a, c, t, g, unknown or other
  modified_base (381)..(381): a, c, t, g, unknown or other
  modified_base (390)..(390): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcagtcaggcattagcattattagctggtatcaacagaaaccagggagagttcctaagctcctgatctatgctgcctcacgttacacctcacggggtcccatctcggttcncgcggcagtgaatcgtgggacagngttcactctcactatccagcagcctgtacncctgaaagnttagttgactaacttattactagtaacaaaatataaatactacgtccctctactaactttcggacggtacggaccgtaaggtcgaaggactacgaaacgtaacgtgtacggtcg

SEQ ID NO: 425909 - DNA, 501 bp, Homo sapiens
  misc_feature: GZ8MTXP02GTY7R.25.4.A04.1.454.CMB.2.raw
  modified_base (194)..(194): a, c, t, g, unknown or other
  modified_base (268)..(268): a, c, t, g, unknown or other
  modified_base (332)..(332): a, c, t, g, unknown or other
  modified_base (396)..(396): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccggcagtcagggcattagcaattatttagcctggtatcaacagaaaccaggganagttcctaagctcctgatctatgctgcctccacgttacacctcacggggtcccatctcggttcnggcggcagtgaatcgtagggacagagttcactctcactatccagcagctgcagcctgagatgtnctactattactatataaataataactaactactccctcctctacgtttacgtacggacgggaccgaacggttacggaggtactacgaaacgaaccgtaagttcgg

SEQ ID NO: 425910 - DNA, 509 bp, Homo sapiens
  misc_feature: GZ8MTXP02GNJ8X.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtccctgacactctcctgcacagcttccggactcacctttggtgagcatgctatgacctgggtccgccaggctccgagggaaggtctggagtggcttgggttcattagaagcgaagcctagtggtggggcaacacaatacgccgcgtctgtaaaaggcagattcagcctctcaagagatgattaccaaaagcatcgacctatctgcacatgagcagcctgagaagcgaggactcagccgtgtacttactgttcttatctctgagtagtagtggttattta

SEQ ID NO: 425911 - DNA, 482 bp, Homo sapiens
  misc_feature: GZ8MTXP02GQFMG.25.4.A04.1.454.CMB.2.raw
  modified_base (328)..(328): a, c, t, g, unknown or other
  modified_base (360)..(360): a, c, t, g, unknown or other
  modified_base (374)..(374): a, c, t, g, unknown or other
  modified_base (376)..(378): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattattagcctggtatcaacagaaaccagggagagttcctaagctcctgatctatgctgcctcacgttacactcaggggtcccatctcggttcngcggcagtgaatctgggacagagttcactctnactatcagcagccncnnncagagatgtagtactacttattactataataaataataatactactcctctctacgtcgtacggacggacgaaggtaggacgacgtacgaacgaacgtacgtcg

SEQ ID NO: 425912 - DNA, 494 bp, Homo sapiens
  misc_feature: GZ8MTXP02JTF0A.25.4.A04.1.454.CMB.2.raw
  modified_base (332)..(332): a, c, t, g, unknown or other
  modified_base (393)..(393): a, c, t, g, unknown or other
  modified_base (398)..(398): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccagggagagttcctaagctcctgatctatgctgcctccacgttacacctcaggggtcccatctcggttcngcggcagtgaatctgggacagagttcactctcactatcagcagcctgcacgcctgaaagtntgtanactaacttattactagtaactaaaatataactactctccctctactacgttcggacggacggacgaaggtacggacgacacgaacgtaacgtagtg

SEQ ID NO: 425913 - DNA, 476 bp, Homo sapiens
  misc_feature: GZ8MTXP02GZQ8L.25.4.A04.1.454.CMB.2.raw
  modified_base (327)..(327): a, c, t, g, unknown or other
  modified_base (341)..(341): a, c, t, g, unknown or other
  modified_base (349)..(349): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattattagcctggtatcaacagaaaccagggagagttccaagctcctgatctatgctgcctccacgttacacctcagggtccatctcgttcngcgcagtgaatcgngggacagngttcactctcactatcagcagctcgcacgctgagatgtagtacacttattatatataaataataatactactcctctactacttcgtacggacggaccgaagtaggaggatacaacgaacgtagtgg

SEQ ID NO: 425914 - DNA, 555 bp, Homo sapiens
  misc_feature: GZ8MTXP02GJOUL.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgacctgggtcccgccagggcctccgaggggaaggtctgggagtggcttggggttcaagttagaagcgaagcctagtgggtggggcaaacacatacgccgcgtctaggtaaaaggcaagattcacgtcctactacaagagatagaacttacccgaaaaagcctaatccgaccttaatctgaccaacagtagacgcagcctagagaacgcggaggactcaggccgttagtacttaccttgttcttattactctagagtagtagtttag

SEQ ID NO: 425915 - DNA, 517 bp, Homo sapiens
  misc_feature: GZ8MTXP02HQYYX.25.4.A04.1.454.CMB.2.raw
  modified_base (277)..(277): a, c, t, g, unknown or other
  modified_base (300)..(300): a, c, t, g, unknown or other
  modified_base (451)..(451): a, c, t, g, unknown or other
tcagactgtacagtcacgaccggtgctcgatttagagtagtgatcaggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggccggtccctgacactctcctgcacagcttccggactcacctttggngagcatgctatgacctgggtccncaggctccgagggaaggtctggagtggctttgggtcattagaagcgaagccctatggtggggcaacacaatcgcgcgtctagtaaaaggcagattcagcctctcaagagatgattaccaaaagcaatcgcctatctgcacatgagcagccngagaagcgaggactcagccgtgtacttactgttacttaattactcttagagtagtagttagtttaa

SEQ ID NO: 425916 - DNA, 500 bp, Homo sapiens
  misc_feature: GZ8MTXP02GQDMA.25.4.A04.1.454.CMB.2.raw
  modified_base (269)..(269): a, c, t, g, unknown or other
  modified_base (394)..(394): a, c, t, g, unknown or other
  modified_base (398)..(398): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccaggganagttccaagctcctgatctatgctgcctcacgttacacctcgagggtcccatctcggttcaggtcggcagtgaatcgtagggacagtagttcactctcatatcagcagcctgcacgctagaagtntgtnactattatatataataaatataactactctaccctctaccgtacggttcggacggtaacggacgtaaggtacgaacgtacgtaacgaaacgtacgtggtacg

SEQ ID NO: 425917 - DNA, 557 bp, Homo sapiens
  misc_feature: GZ8MTXP02F78JV.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactgggtggagtcgtgggggagcttggtacagccagggcccggtccctgacactctcctgcacagcttcccggactcaccttggtgagcatgctatcgaccgtgggtccgccaggcctccgaggggaagggtcgtgggagtgggtcgtttggggttcagttagaagcgaacgcctagtgggtggggacaaacacataccgccgacgtctagtaaaaggcaagattcacgcctactacaaagagatagaacttaccaaaagcaatcgactatctgacacatgacgcagcctagagaagcgaggactcgacgtccgtagtacttactgttaacttattactactagtagtagttagtttag

SEQ ID NO: 425918 - DNA, 552 bp, Homo sapiens
  misc_feature: GZ8MTXP02GU0MJ.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttgggtacagccaggccggtccctgacactctcctgcacagccttccggactcacctttggtgagcatgctatgacctgggtccgccagggctccgaggggaaggtctgggagtgggcttggggttcagtttagaagcgaagcctagtgggtggggcaaacacatacgcgcgtctagtaaaaggcagattcagcctctacaagagatagattaccaaaagcaatcgacctatctagcaacagtgagcacgccgtgagaagacggaggacgtacgacgaccgtgtacgttaacgttcgttaacgtttacttacttactagtagtagttagtttagg

SEQ ID NO: 425919 - DNA, 524 bp, Homo sapiens
  misc_feature: GZ8MTXP02I8MI2.25.4.A04.1.454.CMB.2.raw
  modified_base (276)..(276): a, c, t, g, unknown or other
  modified_base (319)..(319): a, c, t, g, unknown or other
  modified_base (436)..(436): a, c, t, g, unknown or other
  modified_base (442)..(442): a, c, t, g, unknown or other
  modified_base (444)..(447): a, c, t, g, unknown or other
  modified_base (449)..(449): a, c, t, g, unknown or other
  modified_base (451)..(451): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtcctgacactctcctgcacagcttccggactcacctttggngagcatgctatgacctgggtccacaggctccgaggggaggtcnggagtggcttgggtcattagaagcgaagccctatgggtgggacaacgacaatcggccgcgtctagtaaaaggcagattcagccctctacaagagatgattaccaaaagcatcgctanctgcanannnncncngagagacgacgacgcacgcgtacgtacttacttagttacttaacttactactacgtagtagtagttagtttag

SEQ ID NO: 425920 - DNA, 509 bp, Homo sapiens
  misc_feature: GZ8MTXP02J31WJ.25.4.A04.1.454.CMB.2.raw
  modified_base (293)..(293): a, c, t, g, unknown or other
  modified_base (310)..(310): a, c, t, g, unknown or other
  modified_base (331)..(331): a, c, t, g, unknown or other
  modified_base (339)..(339): a, c, t, g, unknown or other
  modified_base (447)..(447): a, c, t, g, unknown or other
  modified_base (508)..(508): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccggcgagtcagggcattagctaattattagcctaggtatacaacagaaaccaggagacgttccaagctcctgatctangctgcctacacgttacnctcgagggtccatctcgttcngcggcagngaatcgtgggacagtagttcactcacactatcaagcacgcctgcgacgaccgtagagtatagttagtactaacttaattaactagtaactaaataaataactactacnccctcctactacgttacggacggacggaccgaaggaggagactacgaacgtaaccgtaggng

SEQ ID NO: 425921 - DNA, 544 bp, Homo sapiens
  misc_feature: GZ8MTXP02HMAHH.25.4.A04.1.454.CMB.2.raw
  modified_base (276)..(276): a, c, t, g, unknown or other
  modified_base (416)..(416): a, c, t, g, unknown or other
  modified_base (503)..(503): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagccttccggactctacctttggngagcatgctatgaccgtgggtccgccaggctccgagggaaggtctggagtggcgtttgggtcagttagaagcgaagcctagtggggtggggcaaacgacaaataccgccgtcgtactaggtaaaaggcagattcagcctnacaagagatgaattaccaaaagcatcgacctatctgcacatgagcagcctgaagagacgaggtactacgagccgtagtacttacgtnttacttataactgtagagtagtagttacggtttatttaaac

SEQ ID NO: 425922 - DNA, 486 bp, Homo sapiens
  misc_feature: GZ8MTXP02G5R42.25.4.A04.1.454.CMB.2.raw
  modified_base (330)..(330): a, c, t, g, unknown or other
  modified_base (431)..(431): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcagtcagggcattagcaattattagcctggtatcaacagaaaccagggagagttcctaagctcctgatctatgctgcctccacgttacaccctcaggggtcccatctcggttcngcgcacgtgaatcgtgggacagagttcactctcactatcagcagccctgcagcctagaagatgtgcaaacttattactagtataaaagtataaattactanccctactcaactttcggcgtaaggaccaaggtggagactcaaaacgacgtgtagg

SEQ ID NO: 425923 - DNA, 520 bp, Homo sapiens
  misc_feature: GZ8MTXP02H99EG.25.4.A04.1.454.CMB.2.raw
  modified_base (193)..(193): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttgccgggcagtcagggcattagcaattattagcctggtatcaaacagaaaccagggagagttcctaagctcctgatctatgctgcctccacgttacacctcgagggtcccatctcggttcagcggcagtgaatcgtaggacagtagtcactctcatatcacgcacgcctacgcgacgccgtagtaagtagtagttagtactaactttaattaacttagttaactaaataaataaactactactcctacctctacgttacgtacggtacggaccgaaggtacggaacgagtaacgaacgaacgtacgtagg

SEQ ID NO: 425924 - DNA, 543 bp, Homo sapiens
  misc_feature: GZ8MTXP02G5C62.25.4.A04.1.454.CMB.2.raw
  modified_base (259)..(259): a, c, t, g, unknown or other
  modified_base (280)..(280): a, c, t, g, unknown or other
  modified_base (329)..(329): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccaggccggtccctgacactctcctgcacngcttccggactcacctttggngagcatgctatgaccgtgggtcccgccagggcctccgaggggaagggtntgggagtgggcttggggttcagttagaagcgaacgcctagtgggtggggcaaacacagtaccgccgcgtctagtaaaaggcagtatcacgcctctacaagagatagattaaccaaaagcatcgctatctgcacatgagcacgctgagaaggcgaggactcgacgcgtagttacttacgtgtttaacttattactcgtagtagtagttagtttag

SEQ ID NO: 425925 - DNA, 501 bp, Homo sapiens
  misc_feature: GZ8MTXP02FPS34.25.4.A04.1.454.CMB.2.raw
  modified_base (332)..(332): a, c, t, g, unknown or other
  modified_base (368)..(368): a, c, t, g, unknown or other
  modified_base (382)..(382): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggcgagtcagggcattagcaattatttagcctggtatcaacagaaaccagggagagttccaagctcctgatctatgctgcctccacgttacacctcgacgggtcccatctcgttcngcgcagtgatctgggacagagttcactctcacttanccagcagcctgacncgcctagaagatgttgactaactttattactagtacaaaagtattaaatactcaccctctactacgtttcggacggacggtacgaagggtaggaagactaacgaaacgaacgtgtacgg

SEQ ID NO: 425926 - DNA, 521 bp, Homo sapiens
  misc_feature: GZ8MTXP02FP1G0.25.4.A04.1.454.CMB.2.raw
  modified_base (304)..(304): a, c, t, g, unknown or other
  modified_base (385)..(385): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggcccggtccctgacactctcctgcacagcttcccggactcacctttggtgagcatgctatgacctgggtccnccagggctccgaggggaaggtctggagtggcttgggtcattagaagcgaagcctagtgggtggggcaacgacatacgccgngtctagtaaaaggcagattcagcctctcaagagatgattaccaaaagcaatcgcctatctgacacatgagcagcctagagaagcgaggactcagccgtgtacttactgttcttattaccttctagagtagtagtag

SEQ ID NO: 425927 - DNA, 499 bp, Homo sapiens
  misc_feature: GZ8MTXP02F7KGP.25.4.A04.1.454.CMB.2.raw
  modified_base (331)..(331): a, c, t, g, unknown or other
  modified_base (351)..(351): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattattagcctggtatacaacagaaaccagggagagttcctaagctcctgatctatgctgcctccacgttacacctcgacgggtccatctcgttcngcgcagtgatcgtggacagngttcactctcatatcagcagcctgccagcctagaagtatgttagactaaactttattactgtaactaaaagtataatactacgcccctctactacgtttcggacggacggaccgaagggtcgaagactacgaaaacgtacgtgtacgg

SEQ ID NO: 425928 - DNA, 522 bp, Homo sapiens
  misc_feature: GZ8MTXP02GIAYJ.25.4.A04.1.454.CMB.2.raw
  modified_base (220)..(220): a, c, t, g, unknown or other
  modified_base (338)..(338): a, c, t, g, unknown or other
  modified_base (399)..(399): a, c, t, g, unknown or other
  modified_base (404)..(404): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttgccgggnagtcgaggcattagctaattattagcctggtatacaaacagaaaccgagggatacgttaccaagctcctgatctatgctcgcctcacgttacacctcgacgggtccagtctcggttcngcgacagtgaatcgtagggacagtgttcactctacactatcagcacgctgcagctagagtntgtanactaattattactagtaactaaaagtactaactactaccgtcccttacgtaccgtacggttccgggacggaacggtaaccgaaggtacgaacggactaacgaaacgtacgtcgtacgg

SEQ ID NO: 425929 - DNA, 525 bp, Homo sapiens
  misc_feature: GZ8MTXP02GTQSL.25.4.A04.1.454.CMB.2.raw
  modified_base (216)..(216): a, c, t, g, unknown or other
  modified_base (267)..(267): a, c, t, g, unknown or other
  modified_base (325)..(325): a, c, t, g, unknown or other
  modified_base (364)..(364): a, c, t, g, unknown or other
  modified_base (386)..(386): a, c, t, g, unknown or other
  modified_base (392)..(392): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgaccagtctccatcctcctgtctgcatctgttggagacagaatcagcatcactgccgggngagtcagggcatagctaattattagcctggtatacaaacagaaacaggganagtcaagctctgatctatgctgcctacacgttacacctcgacgggtccatcgtcgtcngcgcagtagatgtagggacagtagttcactctctactancgagcagcctgcagctagaagntgttanactaacttatttaacagtaactaaaatataaactactaccgtccctactaccgttaacgtttccgggacggaacgggaaccgaaagggtacggggaaagtaaactaccgaaaaacggtaaccgttcggtacgg

SEQ ID NO: 425930 - DNA, 587 bp, Homo sapiens
  misc_feature: GZ8MTXP02HAQZO.25.4.A04.1.454.CMB.2.raw
  modified_base (418)..(418): a, c, t, g, unknown or other
  modified_base (461)..(461): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaacgtggtggagtcgtgggggaggcttggtacagccaggccggtccctgacactctcctgcacagcttccggactcacctttggtgagcatgctatcgacctcgggtccgccaggctccgaggggaagggtctggagtggtcgttgggttcattagagcgaagcccctagtgggtggggacaacacaatccgccgcgtctagtaaaacggcagacttcagccctntacaagagatgattaccaaaagcatcgacctatctgacactanagagacacgccgacgagaaggacggaacggacgtacgacggtaccggtacggttacgttacttacgtttactttaacgtttacttaccgttacggtacggtacggttacggtttaggtttttaaag

SEQ ID NO: 425931 - DNA, 512 bp, Homo sapiens
  misc_feature: GZ8MTXP02GEH9T.25.4.A04.1.454.CMB.2.raw
  modified_base (194)..(194): a, c, t, g, unknown or other
  modified_base (329)..(329): a, c, t, g, unknown or other
  modified_base (359)..(359): a, c, t, g, unknown or other
  modified_base (393)..(393): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcagggcattagcaattattagcctggtatcaacagaaaccagggagagttcctaagctcctgatctatgctgcctcacgttacactcaggggtccatctcggttcngcgcagtgaatctgggacagagttcactcncactatcagcagcctgcacgcctgaagatggttnactaacttattaactgtacaaaagtataaatactactccctctactacgtttcgggacgggtacggaaccgaaagggttcggaagtaacgttacgaaaacgtaaccgtacggttaacgg

SEQ ID NO: 425932 - DNA, 534 bp, Homo sapiens
  misc_feature: GZ8MTXP02H6290.25.4.A04.1.454.CMB.2.raw
  modified_base (221)..(221): a, c, t, g, unknown or other
  modified_base (258)..(258): a, c, t, g, unknown or other
  modified_base (526)..(526): a, c, t, g, unknown or other
  modified_base (532)..(532): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggnagtcgagggcattagcaattattagcctgatacaaanagaaacgagggagagttccaagctctgatctatgttcgcctacctaacgttacactcccgacggggtccctacgtcgttcggttacaggccggacagtagaatcgtaggggacaggtattaccactctacaactatacgacgcacgcctgacacgcctagaagtatgttacgataacttattactagtaactaaaagtataaactaactcacccttctactacggttcggacggacggaaccgtaggaacgagaactacaaacgtacnggtacncg

SEQ ID NO: 425933 - DNA, 518 bp, Homo sapiens
  misc_feature: GZ8MTXP02IKASN.25.4.A04.1.454.CMB.2.raw
  modified_base (252)..(252): a, c, t, g, unknown or other
  modified_base (265)..(265): a, c, t, g, unknown or other
  modified_base (330)..(330): a, c, t, g, unknown or other
  modified_base (341)..(341): a, c, t, g, unknown or other
  modified_base (435)..(435): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgagacagaatcagcatcacttgccggcgagtcagggcattagcaattattagctggtatcaanagaaaccaggganagttccaagcctctgatctatgctcgccctcacgttacacctcgacgggtcccatcgtcggttcnggcgcaggtanatcgtaggggacagtgtcactcactatatccagcagcctgaccagtccctagaacgtattggttacactaatttattactagtactaaaaagtntaactaactcgtaccctacttacgtacgtttcggacgggtaagaccgtaaggtcgaagtactaccgaaaacgtactaggtacg

SEQ ID NO: 425934 - DNA, 499 bp, Homo sapiens
  misc_feature: GZ8MTXP02I4TEN.25.4.A04.1.454.CMB.2.raw
  modified_base (219)..(219): a, c, t, g, unknown or other
  modified_base (269)..(269): a, c, t, g, unknown or other
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaattattagcctggtatcaacagaaaccaggganagttcctaagctcctgatctatgctgcctccacgttacacctcgacggggtccatctcggttcngcgcagtgaatcgtgggacagagttcactctcactatcaagcagcctgcagcctgaagatgttagactaacttattactagtacaaaagtataatactacgcccctctactacgtttcggacggtagggaccgaaggtcggaagactacgaaacgaacgtgtacgg

SEQ ID NO: 425935 - DNA, 514 bp, Homo sapiens
  misc_feature: GZ8MTXP02F3S22.25.4.A04.1.454.CMB.2.raw
  modified_base (403)..(403): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttgggtacagccaggccggtccctgacactctcctgcacagcttccggactcacctttggtgagcatgctatgacctggtccgccaggctccgagggaggtctggagtggcttgggttcattagaagcgaagcctagtggtggggcaacacatacgccgcgtctagtaaaaggcagattcagcctntcaagagatgattaccaaaagcaatcgcctatctgacacatgagcagcctagagaagcgaggactcagccgtagtacttactgttcttattactctagagtagtagtttag

SEQ ID NO: 425936 - DNA, 514 bp, Homo sapiens
  misc_feature: GZ8MTXP02JDPP0.25.4.A04.1.454.CMB.2.raw
  modified_base (275)..(275): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtctgggggagcttggtacagccaggccggtccctgacactctcctgcacagcttccggactcacctttggngagcatgctatgacctgggtccgccagggctccgaggggaaggtctggagtgggcttggggttcattagaagcgaagcctagtggtggggcaacacatacgccgcgtctagtaaaaggcagattcagcctctcaagagatgattaccaaaagcaatccgctatctgcacatgagcagcctgagaagcgaggactcgagccgtgtacttactgttcttattactctgagagttagtttag

SEQ ID NO: 425937 - DNA, 583 bp, Homo sapiens
  misc_feature: GZ8MTXP02JUAU9.25.4.A04.1.454.CMB.2.raw
  modified_base (298)..(298): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacagcttccggactcacctttggtgagcatgctatgacctgggtccncaggctccgagggaggtctggagtggctttgggtcattagaagcgaagctagtgggtggggacaacgacaagtacgccgcgtctagtaaaaggcagattcagcctctacaagagatagacttaccaaaagcatccgacctatctgacacagtgagcaacgcctaggaacggaagcggaacggtacctacgacggtacccggttagttaactttaccgttcgttttacctttaaagtttccttacgtagtacggttaaggttacgtttacggtttaattttaaacg

SEQ ID NO: 425938 - DNA, 627 bp, Homo sapiens
  misc_feature: GZ8MTXP02HGLT4.25.4.A04.1.454.CMB.2.raw
  modified_base (275)..(275): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgtcttttccttgttgctgtttaaaggtgtccaatgtgaggtgcaactggtggagtcgtgggggagcttgggtacagccaggccggtccctgacactctcctgcacagccttccggactcacctttggngagcatgctagtcgaccgtggggtccccgccagggcctcccgaggggaacgggtctgggagtggctttggggtcagttagaagcgaaagcccctaagtggggtaggggacctaaacgacgaagtccggccgtcgtactaaggtaaaaacgggccaaaggtacttcagtccctactacaagagtatagtaacttaaccaaaagctaacttccgaccttaatcctagaccacgatacgagacagtacctagaagaaggacgtaacgggacctacgaacggtccgttagtactttaccgttagtttacctttaagttactacgttaggtagtaaggttacggttaggttttaaac

SEQ ID NO: 425939 - DNA, 570 bp, Homo sapiens
  misc_feature: GZ8MTXP02GFVFD.25.4.A04.1.454.CMB.2.raw
  modified_base (194)..(194): a, c, t, g, unknown or other
  modified_base (278)..(278): a, c, t, g, unknown or other
  modified_base (387)..(387): a, c, t, g, unknown or other
  modified_base (397)..(397): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcgagggcattagactaattatttagcctaggtatacaaacgagaaaccgaggganagttacctaaagctcctagatctatgctgcctcacgttacaccgtcgacggtccatctcggttcagcgacagtagaatcgtaggacagtagttcaactctacacttacncagacacgcngacgacgacgtagaagtagttagtactaacttaacgtttaattaacgtaagttaaactaaaagttaactaaaactaccgtaccgtacccttacgtaccgttacgggttacgggaacggtaacggtaacgtaagggtacgaacgtaaacgtaacgaaaacgtacgtacggtacg

SEQ ID NO: 425940 - DNA, 530 bp, Homo sapiens
  misc_feature: GZ8MTXP02FNKID.25.4.A04.1.454.CMB.2.raw
  modified_base (278)..(278): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggccggtccctgacactctcctgcacagcttccggactcacctttggngagcatgctatgacctgggtccgccaggctccgaggggaagggtctggagtggcttgggttcagttagaagcgaagcccctagtggtggggcaacacaatcgccgcgtctagtaaaaggcagattcagcctctcaagagatgattaccaaaagcatcgcctatctgcacatcgagcagcctgagaagcgaggactcgacgtccgtagtacttacttgtttacttaattactctagtagtagtagttgtttaa

SEQ ID NO: 425941 - DNA, 562 bp, Homo sapiens
  misc_feature: GZ8MTXP02HQC85.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccaggccggtccctgacactctcctgcacagccttccggactcacctttggtgagcatgctatgacctgggtcccgccaggcctccgaggggaaggtcgtgggagtggtcgttgggttcagttagaagcgaagcctagtgggtggggcaaacacagtacgccgcgtactagtaaaaggcaagattcagccctactacaagagatagacttaccaaagcaatcgcctatctgacacatgagcacgctagagaagcgtaagggactacgacgtccgttagtactttacgttgtttaacctttattaccttcgtaggtacgtaggtttagtttagg

SEQ ID NO: 425942 - DNA, 537 bp, Homo sapiens
  misc_feature: GZ8MTXP02GZ6OZ.25.4.A04.1.454.CMB.2.raw
  modified_base (273)..(273): a, c, t, g, unknown or other
  modified_base (296)..(296): a, c, t, g, unknown or other
  modified_base (511)..(511): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagcttccggactcacctttggngagcatgctatgacctgggtccnccaggctccgagggaggtctggagtggcttggggttcagttagaagtcgaaagcctagtgggtggggacaaacacaaatacgccgcgtctaggtaaaaggcaagattcagcctctacaagagatagacttaccaaaagcatcgacctatctgacacatgagcagccagagaagcgaaggactcgagccgtagtacttactgttacttattaactntagtagtagtagttaggttatttaac

SEQ ID NO: 425943 - DNA, 531 bp, Homo sapiens
  misc_feature: GZ8MTXP02HOARA.25.4.A04.1.454.CMB.2.raw
  modified_base (348)..(348): a, c, t, g, unknown or other
  modified_base (417)..(417): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttggagacagaatcagcatcacgttggccgggcgagtcgagggcattagactaattattagcctggtatacaaacaagaaaccgagggagtagttacctaagctcctgatctatgtctcgcctccacgttacacctcgacggggtccagtctcggttcncgcggctagtgaatcgtaggacagtacgtcactctcatatcagcacgctgcagcctagaagattggtanactaacttatactagtaacaaaagtataactactctacccttctacctacggttacgggacggtaacggaccgtaaaggtacggaagactaacgaaaccgtaagttcggtacgg

SEQ ID NO: 425944 - DNA, 508 bp, Homo sapiens
  misc_feature: GZ8MTXP02IQ8SL.25.4.A04.1.454.CMB.2.raw
  modified_base (219)..(219): a, c, t, g, unknown or other
  modified_base (349)..(349): a, c, t, g, unknown or other
  modified_base (397)..(397): a, c, t, g, unknown or other
  modified_base (407)..(407): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaattattagcctggtatacaaacagaaaaccgagggagagtttcctaagctcctgatctatgctgcctccacgttacacctcgaggggtcccatcctcggttcaggcgcaggtnaagtcgtaggggacaggtattcactctctacctatcagcagcctgacngcctagaagnttgtcacctaattattactagtactaaaagtataataactcgaccctctactacgtttcggacggacggacgaaggtcgagactacgaaacgtacttgcgg

SEQ ID NO: 425945 - DNA, 512 bp, Homo sapiens
  misc_feature: GZ8MTXP02JX17I.25.4.A04.1.454.CMB.2.raw
  modified_base (340)..(340): a, c, t, g, unknown or other
  modified_base (381)..(381): a, c, t, g, unknown or other
  modified_base (405)..(405): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagcaattattagcctggtatacaacagaaaccagggatagttcctaagctacctgatctatcgctgcctccacgttacacctcgacggggtcccatcgtcggttcngcggcagtgaatcgtgggacagtacgttcactctacactancacgcacgctgacacgcgtagatntgtanacttaattatatataataaatataactactcctcctctacgtacggttacgggacggaacggaacgaaggtacggaacgtacgtaacgaaacgtacgtgtcg

SEQ ID NO: 425946 - DNA, 521 bp, Homo sapiens
  misc_feature: GZ8MTXP02I8VV1.25.4.A04.1.454.CMB.2.raw
  modified_base (275)..(275): a, c, t, g, unknown or other
  modified_base (406)..(406): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttcctgttgctgttttaaaaggtgtccaatgtgaggtgcaactggtggagtctgggggagcttggtacagccaggccggtccctgacactctcctgcacagccttccggactcacctttggngagcatgctatgacctgggtccgccaggctccgaggggaaggtctggagtggcttgggttcattagaagcgaagcccctagtggtggggcaacacaatcggccgcgtctagtaaaaggcagattcagcctntcaagagatgattaccaaaagcatcgcctatctgcacatgagcagcctgagaagcgaggactcacgccgtgtattacgttgttacttaattactctgagtagtagttaggtttaa

SEQ ID NO: 425947 - DNA, 531 bp, Homo sapiens
  misc_feature: GZ8MTXP02GCWCJ.25.4.A04.1.454.CMB.2.raw
  modified_base (277)..(277): a, c, t, g, unknown or other
  modified_base (511)..(511): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactggtggagtcgtgggggaggcttgggtacagccagggccggtccctgacactctcctgcacagcttccggactcacctttggngagcatgctatgacctgggtccgccaggctccgaggggaaggtctggagtggcgttgggtcattagaagcgaagcccctagtgggtggggacaacggcaatcgccgcgtctagtaaaaggcagattcagcctctcaagagatgattaccaaaagcaatcgacctatctgcacatgagcacgcctgagaagcgaaggactcgacgccgtagtacttacttgttacttaagttacnctagagtagtagtagtttaa

SEQ ID NO: 425948 - DNA, 539 bp, Homo sapiens
  misc_feature: GZ8MTXP02G9292.25.4.A04.1.454.CMB.2.raw
  modified_base (279)..(279): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttgggtacagccaggcccggtcccggacactctcctgcacagcttccggactcacctttggngagcatgctatcgacctgggtcccgcaggctccgaggggaaggtctggagtggcttgggtcattagagcgaagccctagtggtgggacaacacaatccgccgcgtctagtaaaaggcagacttcagccctctacgaagagatgacttaccaaaagcaatccgactatctgacacatgagcagcctagaagaagcgaaggctgacgtccgtagtacttacttgtttacttaagttactctagagtagttagttaggtttaa

SEQ ID NO: 425949 - DNA, 499 bp, Homo sapiens
  misc_feature: GZ8MTXP02GAISR.25.4.A04.1.454.CMB.2.raw
  modified_base (360)..(360): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaatatttagcctggtatcaacagaaaccagggagagttcctaaagctcctgatctatgctgcctcacgttacacctcaggggtccatctcggttcagcgcagtgaatctgggacagagtcactctnactatcagcagcctgcagcctagaagatgttgactaacttattactagtacaaaagtataataactgacccctctcctaactttcggacggtacgggacccaaagggtcggaagtactacgaaaacgaacgtggtacgg

SEQ ID NO: 425950 - DNA, 502 bp, Homo sapiens
  misc_feature: GZ8MTXP02J1EWE.25.4.A04.1.454.CMB.2.raw
  modified_base (219)..(219): a, c, t, g, unknown or other
  modified_base (268)..(268): a, c, t, g, unknown or other
  modified_base (330)..(330): a, c, t, g, unknown or other
  modified_base (368)..(368): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggnagtcagggcattagcaattattagcctggtatcaacagaaaccaggganagttacctaagctcctgatctatgctgcctcacgttacacctcgacgggtccatctcgttcngcgcagtgaatcgtgggacagtagtcactctcacttcncagcacgcctgcacgcctagagtatggttacactaactttattacgtagtaactaaaattactaatacctcgccctctactacgttcggacggacggtaaccgaaggtcggaacactacgaacgtactggtacg

SEQ ID NO: 425951 - DNA, 495 bp, Homo sapiens
  misc_feature: GZ8MTXP02HP4F0.25.4.A04.1.454.CMB.2.raw
  modified_base (332)..(332): a, c, t, g, unknown or other
  modified_base (402)..(402): a, c, t, g, unknown or other
  modified_base (435)..(435): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagcaattattagcctggtatcaaacagaaaccagggagagttccaagctcctgatctatgctgcctccacgttacacctcgaggggtcccatctcggttcngcgggcagtgaatcgtagggacagagttcactctcactatcagcagcctgcagcctagaagtatggttanctaacttattactgtacaaagtataatactacnccctctctacgtttcggacggtacgggaccgaaggtgagactacgaaacgaactggtcgg

SEQ ID NO: 425952 - DNA, 519 bp, Homo sapiens
  misc_feature: GZ8MTXP02HIUGW.25.4.A04.1.454.CMB.2.raw
  modified_base (275)..(275): a, c, t, g, unknown or other
  modified_base (298)..(298): a, c, t, g, unknown or other
  modified_base (320)..(320): a, c, t, g, unknown or other
  modified_base (417)..(417): a, c, t, g, unknown or other
  modified_base (476)..(476): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttgggtacagccaggccggtccctgacactctcctgcacagccttccggactcacctttggngagcatgctatgacctgggtccnccaggctccgaggggaaggtcnggagtggctttggggtcagttagaagcgaaagcctagtgggtggggcaaacacaatacgccgcgtctagtaaaagcagattcagtcctctcaaaganatgaattaccaaaagcatcgacctatcctagcacatgagcagcctgagagcgaggactnagctgtactactgttacttatctctgagtagtagtgttattaa

SEQ ID NO: 425953 - DNA, 526 bp, Homo sapiens
  misc_feature: GZ8MTXP02GAVZW.25.4.A04.1.454.CMB.2.raw
  modified_base (503)..(503): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttggtacagccaggccggtccctgacactctcctgcacagcttccggactcacctttggtgagcatgctatgacctgggtccgccaggctccgagggaaggtctggagtggctttgggtcagttagaagcgaaagcctagtgggtggggacaacacaatacgccgcgtctagtaaaagcaagattcagcctctacaagagatagattacaaaagcatcgacctatctgcacatgacgcagcctaggagaagcgaggactcgagccgtagtacttactgttcttataactntagagtagtagtaggttatttaa

SEQ ID NO: 425954 - DNA, 511 bp, Homo sapiens
  misc_feature: GZ8MTXP02FK0X9.25.4.A04.1.454.CMB.2.raw
  modified_base (194)..(194): a, c, t, g, unknown or other
  modified_base (338)..(338): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcgagggcattagctaattattagcctaggtatacaacagaaaccagggagacgttacctaagctcctgatctatgctgcctcacgttacacctcgacgggtccatcgtcggttcngcgcagtgaatcgtgggacagagttcactcacactatcagcagcctgcagcctagagtatgttagacctaattattactgtaactaaaagtataaaactctacgccctctctacgtttcgggacggacggaaccgtaagggtacgaacgtactaacgaaacggtacgtggtcg

SEQ ID NO: 425955 - DNA, 501 bp, Homo sapiens
  misc_feature: GZ8MTXP02GEMX1.25.4.A04.1.454.CMB.2.raw
  modified_base (219)..(219): a, c, t, g, unknown or other
  modified_base (307)..(307): a, c, t, g, unknown or other
  modified_base (329)..(329): a, c, t, g, unknown or other
  modified_base (397)..(397): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagctaattattagcctggtatacaacagaaaccagggagagttaccaagctcctgatcatgctgcctcacgtacncctcgagggtccatctcgttcngcgcagtgaatgtgggacagagttcactctcactatcagcacgccagcaggcctagaagtatggttanacctaatttataacttagtaacaaattaataaatactctaccctctactacgtttcggacggtaacggaccaaggtcggaagtacgtacaaacgacgtgtacgg

SEQ ID NO: 425956 - DNA, 487 bp, Homo sapiens
  misc_feature: GZ8MTXP02IWL7X.25.4.A04.1.454.CMB.2.raw
  modified_base (330)..(330): a, c, t, g, unknown or other
  modified_base (380)..(380): a, c, t, g, unknown or other
  modified_base (383)..(383): a, c, t, g, unknown or other
  modified_base (429)..(429): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccgggcagtcagggcattagcaattattagcctggtatcaacagaaaccagggagagttcctaaagctcctgatctatgctgcctccacgttacacctcagggtcccatctcggttcngcgcagtgaatcgtggggacagagttcactctcactatcagcagctgcanccngagatgttgactaacttattactagtactaaaataataatactacnccctcctctacttcgtacggacggaccgaaggtaggagatacgaaacgaacgtagtgg

SEQ ID NO: 425957 - DNA, 525 bp, Homo sapiens
  misc_feature: GZ8MTXP02GFWTY.25.4.A04.1.454.CMB.2.raw
  modified_base (347)..(347): a, c, t, g, unknown or other
  modified_base (351)..(352): a, c, t, g, unknown or other
  modified_base (355)..(355): a, c, t, g, unknown or other
  modified_base (368)..(368): a, c, t, g, unknown or other
  modified_base (373)..(373): a, c, t, g, unknown or other
  modified_base (383)..(383): a, c, t, g, unknown or other
  modified_base (386)..(386): a, c, t, g, unknown or other
  modified_base (392)..(392): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttggccgggcgagtcgagggcattagctaatttatttagcctggtatcaacgagaaaaccagggaagtagttaccaagccttacctagactctatcgctgcctacacgttacacctcgacgggtccatcgtcgttngcgnngtnatcgtaggacagngttcnctctcactancancacgcnacacgcgtagaagtatacgtacaacttaattattacgtaagtaactaaaagtataacttactcctaccctcgtacgtacggttcggacggtaacggacgaaggtacgaacgtactaacgaacgtacgtcgtcg

SEQ ID NO: 425958 - DNA, 652 bp, Homo sapiens
  misc_feature: GZ8MTXP02GGFSH.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggcccgtccctgacactctcctgcactagccttccggactctacctttggtgagcatgctatgaccgtgggtcccgccagggcctccggaggggtaagggtcgtgggagtgggtcgtttggggttcagttaggaaggcgaacgtcctaagtggggtaggggacaaacacaacgtaccgcccggtcgttaccgtaaggtaaaaaggcaaaggtacttaccgaacgccctacgtaacaaagagaattagtaacttaacccgaaaaagcaacgtccgacctattctcgacacagtagacgcaacggcctaggaaacggaaacggacggaaacggtacctaccgaacggtcccggttataacgttttaccttagtttaacctttaatttacttcgtaggtaacggtaaggtttaacggtttaagg

SEQ ID NO: 425959 - DNA, 711 bp, Homo sapiens
  misc_feature: GZ8MTXP02HD52W.25.4.A04.1.454.CMB.2.raw
  modified_base (279)..(279): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagccttccggactcacctttgggngagcatgactagtcgtaccgtcgggtcccgccgacggccgtacggaaggggtaacggtcgtaggggaggttcgggtcgtttggggttactaagttaaggaaacggtacggaaccgtccgttaggtcggggtacggggaacaaaccgaacgtacgtaccggccggtacggttacgtaaagggtaaaacggctaaagtacttacgaacgtaccctacgtaacgaaagacgtaagtaacgtaaacttaaaccgaaaagtccgtaacgtacccgtacctacttccgtacgtacctaacgtagtacggacgacgacgtaccgtaaggaacggaacggtacggaacggtaccgtacgacggttaccggttagttaacgtttacgttacgtttaacgtttaacgttacgttacgtaggtacgttaggtttaggtttacg

SEQ ID NO: 425960 - DNA, 517 bp, Homo sapiens
  misc_feature: GZ8MTXP02GJ7M3.25.4.A04.1.454.CMB.2.raw
  modified_base (267)..(267): a, c, t, g, unknown or other
  modified_base (325)..(325): a, c, t, g, unknown or other
  modified_base (373)..(373): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccgggcgagtcagggcattagcaattattagcctggtatcaacagaaaccaggganagttcctaaagctcctgatctatgctgctccacgttcactcagggtccatctcgttcngcgcagtgaatctgggacagagttcactctcactactcagcagtcccncgcacgactagagtagtagttagtactaacttacttactacgtaactaaagtaataactactacgtaccctacctacctaccgttacggtacggacggaacgtaacggtacggtaacgtacgtaacgaaacgtaacgtacgtcg

SEQ ID NO: 425961 - DNA, 629 bp, Homo sapiens
  misc_feature: GZ8MTXP02IWNJA.25.4.A04.1.454.CMB.2.raw
  modified_base (338)..(338): a, c, t, g, unknown or other
  modified_base (346)..(346): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccgggcgagtcgagggcattagcaattattagcctggtatacaacaagaaaccgagggagagttcctaagctcctgatctatgctcgcctaccacgttacacctcgagggtcccatctcggttcngcgcagtnaatcgtagggacagtattcactctcactagtcagcacgcctacgcacgtaccgtacgtaagtagtaggttacgtacgtaaacctttaaatttaaccgttaagttaaaccgttaaaaacgttaaaattaaaacgtttaaaccgttaacccgttccccgttacccttacccgttaacccggtttaccggggttaaccggggtaacgggggaaacccggtaaacggggttaacgggtaacggaaagttaaacgaaaaccggtaaaccggttaaacggtttacgggg

SEQ ID NO: 425962 - DNA, 541 bp, Homo sapiens
  misc_feature: GZ8MTXP02JB2LD.25.4.A04.1.454.CMB.2.raw
  modified_base (365)..(365): a, c, t, g, unknown or other
  modified_base (445)..(445): a, c, t, g, unknown or other
  modified_base (508)..(508): a, c, t, g, unknown or other
  modified_base (523)..(523): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccagggccggtccctgacactctcctgcacagcttccggactcaccttggtgagcatgctatgacctgggtccgccagggctccgaggggaaggtcgtggagtggcgttggggttcagttagaagcgaagcctagngggtggggacaacgacagtaccgccgcgtctagtaaaagcagatcacgcctctacaagagatgaataccaaaagcagtcnctatctgacacagtagagcacgtcagaagaaggacggaggactcgacgccgtagtacttcgtnttaacttacttactntagagtagtagtttaacg

SEQ ID NO: 425963 - DNA, 535 bp, Homo sapiens
  misc_feature: GZ8MTXP02GCL35.25.4.A04.1.454.CMB.2.raw
  modified_base (390)..(390): a, c, t, g, unknown or other
  modified_base (508)..(508): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtggggggaggcttgggtacagccaggccggtccctgacactctcctgcacagcttccggactcacctttggtgagcatgctatgacctgggtccgccaggctccgaggggaaggtctgggagtgggcgttggggttcagttagaagcgaagcctagtgggtggggacaacgacatacgccgngtcgtagtaaaaggcagattcagcctctacaagagatgaacttaccaaaagcaatccgacctatctgcaacatgagcacgctagagaacgcgtaggactcgagccgtagtacttcgtnttcttatactctagagtagtagtttag

SEQ ID NO: 425964 - DNA, 526 bp, Homo sapiens
  misc_feature: GZ8MTXP02JLRST.25.4.A04.1.454.CMB.2.raw
  modified_base (275)..(275): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggacagccaggcccggtccctgacactctcctgcacagccttccggactcacctttggngagcatgctatgacctgggtccgccaggctccgagggaggtctggagtggcttgggttcattagagcgaagcctagtgggtgggcaacacaagtacgccgcgtctagtaaaaggcaagattcagcctctcaagagatgattaccaaaagcatcgacctatctgcacatgagcagccgtgagagcgaggactcgagccgtgtacttactcgttcttataacgtctaggtacgtagtagttaggttatttaac

SEQ ID NO: 425965 - DNA, 592 bp, Homo sapiens
  misc_feature: GZ8MTXP02GEF6Z.25.4.A04.1.454.CMB.2.raw
  modified_base (269)..(269): a, c, t, g, unknown or other
  modified_base (331)..(331): a, c, t, g, unknown or other
  modified_base (336)..(336): a, c, t, g, unknown or other
  modified_base (377)..(377): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattatttagcctggtatcaacagaaaccaggganagttctaagctcctgatctatgctgcctcacgttacacctcgacgggtcccatctcggttcngccgnagtgaatcgtagggacagtagttccactctacaacgttacncgagctacgcctacgacgacgaccgtagtaagtagttacgttacgtacttaaactttaacttaacgttacgttaaacgtaaaagttaaacttaaacttaaccgttaccgtacccttacccttaccgttaccgtttaccgggtaccgggtaacgggtaaccggtaacgggtaacggtaacggtaaacgtaacgtaaaacggtaacgtacggtacgg

SEQ ID NO: 425966 - DNA, 522 bp, Homo sapiens
  misc_feature: GZ8MTXP02GNVG3.25.4.A04.1.454.CMB.2.raw
  modified_base (277)..(277): a, c, t, g, unknown or other
  modified_base (474)..(474): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttgggtacagccaggccggtccctgacactctcctgcacagcttccggactcacctttggngagcatgctatgacctgggtccgccaggctccgaggggaagggtctggagtggcttgggtcattagaagcgaagcccctagtggtggggcaacacaatccgccgcgtctagtaaaaggcaagattcagccctctcaagagatgaattaccaaaagcatcgcctatctgcacatgagcagcctgagaagcgaggactnacgcgtagtacttactgttcttaattactctgagagtagtaggtttaa

SEQ ID NO: 425967 - DNA, 550 bp, Homo sapiens
  misc_feature: GZ8MTXP02FR6U8.25.4.A04.1.454.CMB.2.raw
  modified_base (219)..(219): a, c, t, g, unknown or other
  modified_base (335)..(335): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggngagtcagggcattagctaattatttagcctggtatacaacagaaaccagggagagttccaagctcctgatctatgctcgcctcacgttacacctcgacgggtccatcgtcggttcnggcgcagtcgaatcgtagggacagtcgttcactctacactatcagtcacgcctagaccgagccttaggaaagttnttacgttacaacttaacttacttacgtaacgtaaactaaaagttactaactacctaccgtacccttactaccgttacggttcgggacgggaacggtaacgaagggtacgaacgtactaacgaaaacgtacgtacggtacg

SEQ ID NO: 425968 - DNA, 571 bp, Homo sapiens
  misc_feature: GZ8MTXP02IHA85.25.4.A04.1.454.CMB.2.raw
  modified_base (193)..(193): a, c, t, g, unknown or other
  modified_base (274)..(274): a, c, t, g, unknown or other
  modified_base (503)..(503): a, c, t, g, unknown or other
  modified_base (511)..(511): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttggccgggcgagtcgagggcattagctaattattagcctggtatacaaacagaaaccgaggganacgtttcctaagcctctgactctatgctcgtccctaccacgttacaccctacgagggactcccagttccgttcgggtttcgacggtcggacctaaggttagaacttcgggtaggggactagtacgtttacacttcttaacacgtttacacagcacgcctcgacgacgccttagaaagttgtgttacgacttaaacttattaactagtaactaaaattataaactctacnccctttanacgttacgttacgggacggaaggaaccgtaaggtcgaagtacgtacgaaacggtactggg

SEQ ID NO: 425969 - DNA, 534 bp, Homo sapiens
  misc_feature: GZ8MTXP02HQ4X2.25.4.A04.1.454.CMB.2.raw
  modified_base (220)..(220): a, c, t, g, unknown or other
  modified_base (324)..(324): a, c, t, g, unknown or other
  modified_base (352)..(352): a, c, t, g, unknown or other
  modified_base (366)..(366): a, c, t, g, unknown or other
  modified_base (421)..(421): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcgagggcagttagactaatttatttagcctggtatacaaacagaaaccagggaagacgtttaccaagctacctagatctatgctcgcctaccacgttacncctacgacggggtcctagtctcggttcngcgcagtgaatcgnggacagtagtcactctcactatcagcacgctgcacgcgtagaagtacttggttanactaaatttattactagtactaaaagtataactactcgtaccctctacgtacgtttacggacggtaacggaacgaaggtacggaacgtacgacgtaaacgacgttacggtacg

SEQ ID NO: 425970 - DNA, 518 bp, Homo sapiens
  misc_feature: GZ8MTXP02I8XHG.25.4.A04.1.454.CMB.2.raw
  modified_base (276)..(276): a, c, t, g, unknown or other
  modified_base (299)..(299): a, c, t, g, unknown or other
  modified_base (376)..(376): a, c, t, g, unknown or other
  modified_base (468)..(468): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacagcttccggactcacctttggngagcatgctatgacctgggtccncaggctccgagggaaggtctggagtggcttgggttcattagagcgaagccctatgggtgggcaacgacaatcgccgngtctagtaaaaggcagattcagccctctacaagagatgattaccaaaagcatcgctatctgacacatgagcagcctgagaagcgacggactnacgcctagtacttactgttacttaatactcgtgagtagttagtagtttaa

SEQ ID NO: 425971 - DNA, 525 bp, Homo sapiens
  misc_feature: GZ8MTXP02G8L9Q.25.4.A04.1.454.CMB.2.raw
  modified_base (383)..(383): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgacctgggtccgccaggcctccgagggaagagtctggagtggcttggggttcagttagaagcgaagcccctagtgggtggggcaacgacaatcgccgngtctagtaaaaggcagattcagcctctcaagagatgattaccaaaagcatcgctatctgcacatgagcagcctagagaagcgtacggactcgacgccgtgtacttactgttcttaagttactcgtgagtagtagtggtttaa

SEQ ID NO: 425972 - DNA, 705 bp, Homo sapiens
  misc_feature: GZ8MTXP02H0ESM.25.4.A04.1.454.CMB.2.raw
  modified_base (279)..(279): a, c, t, g, unknown or other
  modified_base (282)..(282): a, c, t, g, unknown or other
  modified_base (340)..(340): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaatggtggagtcgtgggggagcttggacagccagggccggtccctgacactctcctgcacagccttcggactcacctttggngancatgctagtcgaccgtcgggtccgccgacggcctaccggaaggggaaggtcgtagggnggtgggtcgtttgggtactaagttaagaaggacgaacgtccgtaggtggggtacgggacaaacgaactacgtaaccgccggtaccggttacgtaaaggtaaaaacgctaacgtaacgtacgacgtacccgtaccgtacgaaagaagtaagtaagtaaacgtaaaccgtaaaacgaactaacgtaccgtacctacgttacgtacgacaactaacgtaagaacgacgaacgtacgtaacggaaacggaaaacggaacggaacggaaccgtacgtaacggtaccggttacgttaacgtttaacgtttacgtttaacgtttaactttaacgttacgttaaggtaacggttaacggtttaaggtttaagg

SEQ ID NO: 425973 - DNA, 516 bp, Homo sapiens
  misc_feature: GZ8MTXP02IZ62G.25.4.A04.1.454.CMB.2.raw
  modified_base (271)..(271): a, c, t, g, unknown or other
  modified_base (334)..(334): a, c, t, g, unknown or other
  modified_base (407)..(407): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagctaattatttagcctggtatcaacagaaaccaggganagttacaagctcctgatctatgctgcctccacgttacacctcgacgggtccatcgtcggttcngcgcagtgaatcgtaggggacagagttcactctacactatccagcagcctgctagcctagaagactggttacnctaaacttattacgtagtaactaaaagtattaactactcgtcccctctctacgtttcgggacggtaggaaccgtaaggtcggaagaactacgaaaacgtacgtagtcgg

SEQ ID NO: 425974 - DNA, 647 bp, Homo sapiens
  misc_feature: GZ8MTXP02GRLD0.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttgggtacagccaggccggtcctgacactctcctgcacagccttccggactcctaccgttggtgagcatgctagtcgaccgtgggtcccgccgagggcctccgaggggtaacggggtcgtggggtagtgggtcgtttggggttactagttaggagcgaagcctagtgggtggggacaacacagtaccgccgtcgtcgtaggtaaaaggcaagtattcgagtccctcgtacaaagagaactgtaacttaacccgaaaaagtcctaaagtcccgtacctacgttctcgacaacagtagacgccacggcccgtaggaaacggaacggccggaaggaccttaccgacggtacccgtttagttaacgtttacctttgtttaacctttaaactttacgttaccgtaggtacggttaacggtttaggtttttaacgg

SEQ ID NO: 425975 - DNA, 548 bp, Homo sapiens
  misc_feature: GZ8MTXP02GXJPF.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtggggggaggcttgggtacagccagggccggtccctgacactctcctgcacagccttccggactcacctttggtgagcatgctatgacctggggtccgccagggcctccgaggggaaggtctgggagtgggtcgtttggggttcaagttagaagcgaaacgcctagtgggtggggacaaacacagtcgccgcgtctagtaaaaggcagatcagcctctacaagagatagaattaccaaaagcatcgacctatctgcacatgagcacgccgtagagaaggcgaggactcgacgccgttagtacttactgttaacttattactcgtagtagtagtagtttag

SEQ ID NO: 425976 - DNA, 522 bp, Homo sapiens
  misc_feature: GZ8MTXP02JMAR9.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttgggtacagccagggccggtccctgacactctcctgcacagccttccggactcacctttggtgagcatgctatgacctgggtccgccaggctccgagggaaggtctggagtggcttggggttcagttagaagtcgaagcctagtgggtaggggacaaacacaaatacgccgcgtctaggtaaaagcagattcagcctctcaagagatgattaccaaagcatcgctatctgcacatgagcagcctgagaagcgaggactcgagccgtagtacttactgttcttatctctgtagagtagttgttatttaa

SEQ ID NO: 425977 - DNA, 518 bp, Homo sapiens
  misc_feature: GZ8MTXP02FXCSS.25.4.A04.1.454.CMB.2.raw
  modified_base (269)..(269): a, c, t, g, unknown or other
  modified_base (330)..(330): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcagggcattagctaattattagcctggtatcaacagaaaccaggganagttactaagctcctgatctatgctgcctcacgttacacctcgacgggtccatctcgttcngcgcagtgaatcgtgggactaggagttcacgtctacatatccagcagcctgacagcctagaagtatgtagaccttaattatactagtaactaaaaagtataaatactcgtacccctacgtactacgtttccggacgggtacggaaaccgaaggtacggaacgaagtaccgaaaacgtacgtggtacgg

SEQ ID NO: 425978 - DNA, 510 bp, Homo sapiens
  misc_feature: GZ8MTXP02HXW5P.25.4.A04.1.454.CMB.2.raw
  modified_base (329)..(329): a, c, t, g, unknown or other
  modified_base (367)..(367): a, c, t, g, unknown or other
  modified_base (377)..(377): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccagggagagttcaagctcctgatctatgctgcctccacgttacactcacgggtcccatctcggttcnggcgcagtgaatcgtggacagagttcactctcacttancagcacgccngacacgctagtaagtagtagtacgtacttaacttattactagtaaactaaaagtaataactactccgtaccctactacgtacgttcggacggacggaacgaaggtacgaagtactaacgaacgtacgtacgcg

SEQ ID NO: 425979 - DNA, 543 bp, Homo sapiens
  misc_feature: GZ8MTXP02HO15S.25.4.A04.1.454.CMB.2.raw
  modified_base (219)..(219): a, c, t, g, unknown or other
  modified_base (270)..(270): a, c, t, g, unknown or other
  modified_base (384)..(384): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgaccccagtctccatcctccctgtctgcatctgttggagacagaatcagcatcacttgccggngagtcagggcattagcaattattagcctggtatcaaacagaaaccaggganagttcctaagctcctgatctatgctgcctccacgttacacctcgaggggtcccagttctccggttcacggtcggcagtcgaaattcgagggacagtagttcactctcacttacncagcgacgctgacacgtcgtaagagtagttagtacgtactaaacgttattaacgtagtaaactaaaattactaacttactcctccctacttaccgttacgttacgggacggtaacggacgtaagggtacgaacgtactaacgaaacgtacgtacggtcg

SEQ ID NO: 425980 - DNA, 484 bp, Homo sapiens
  misc_feature: GZ8MTXP02HQZPJ.25.4.A04.1.454.CMB.2.raw
  modified_base (194)..(194): a, c, t, g, unknown or other
  modified_base (218)..(218): a, c, t, g, unknown or other
  modified_base (330)..(330): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccggngagtcagggcattagcaattattagctggtatcaacagaaaccagggagagttcctaagctcctgatctatgctgcctccacgttacacctcaggggtcccatctcggttcngcgcagtgaatcgtaggacagagttcactctcactatcagcagctgcagcctagaagattgtgactaattattactagtacaaaagtataaatactcgtaccctctctacttcggcggacggacgaaggtgaagtcacaaacgtaactgtacgg

SEQ ID NO: 425981 - DNA, 585 bp, Homo sapiens
  misc_feature: GZ8MTXP02H1VKE.25.4.A04.1.454.CMB.2.raw
  modified_base (276)..(276): a, c, t, g, unknown or other
  modified_base (299)..(299): a, c, t, g, unknown or other
  modified_base (318)..(318): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactgggtggagtcgtgggggagcttggtacagccaggccggtccctgacactctcctgcacagcttccggatcacctttggngagcatgctatgacctgggtccncaggctcgaggggaggtcnggagtggcttgggtcagttagaagcgaagccctagtggggtgggacaacacgaatccggccgtgtacctaggtaaaaggcaagtattcgagcctctacaagagattgaacttaccgaaaagcatccgtcctaatctgacacagtcgagactacgcaggaagacgacggtacggaacttcgacggtccgttagttacgttaacttcggtttactttaaacgttacccttcgtacgggtagtaacgggtttacgtttaacggttttaaa

SEQ ID NO: 425982 - DNA, 556 bp, Homo sapiens
  misc_feature: GZ8MTXP02GFYMY.25.4.A04.1.454.CMB.2.raw
  modified_base (219)..(219): a, c, t, g, unknown or other
  modified_base (331)..(331): a, c, t, g, unknown or other
  modified_base (367)..(367): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggngagtcagggcattagcaattatttagcctggtatacaacagaaaccagggagagttcctaaagctcctgatctatgctgcctcacgttacactcacgggtccatctcgttcngcgcagtgatcgtggacagagttcactctcactacncacgcacgctcgacgacgacgtagaagtagtagttagtactaacttaacttaacttaacgtaaacgtaaaagtaaaattaaacttaacttaccgtacccttacctaccgttaccgttaccggtaccgggaacgggaaccggtaaacggtaacggaacgtaacgtaacgaaaacgtaacgtacggtacgg

SEQ ID NO: 425983 - DNA, 631 bp, Homo sapiens
  misc_feature: GZ8MTXP02G1SP8.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctagttttaaaaggtgtccaatgtgaggtgcaactggtggagtcgtgggggagcttggtacagccaggccggtccctgacactctcctgcacagccttccggactctacctttggtgagcatgctagtcgacccgtgggtcccgccgaggcctccggaggggaaggtcgtgggagtgggtcgtttggggttcaagttagaaggtcgaacgccgtagtggggtcggggacaaacgtaacacgtaccgcccgtacgtacgtaaggtaaaacggctaagtacttacgacgtccctacgtacgaaaggagacgtagtaacttaaccgaaaaagcaaactccgaccttatctcgacaacagtgagcacgccaggaacgaaggacggaacggacctacgacggtccggttagttactttacgttagtttaacctttattaccgttacgtagtaagttaggtttagtttaacgg

SEQ ID NO: 425984 - DNA, 584 bp, Homo sapiens
  misc_feature: GZ8MTXP02FVZX5.25.4.A04.1.454.CMB.2.raw
  modified_base (219)..(219): a, c, t, g, unknown or other
  modified_base (343)..(343): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccggngagtcagggcattagactaattattagcctggtatacaaacagaaaccgagggagagttacctaagctcctagtactctatcgctcgcctccacgttacacctcgacgggtccatcgtcgttcngcgcagtgatcgtagggacagcgttcactctactactatcagctacgcctcgacacggcctaggaacgtgttaggttacaaccttaagtttaacttacgttacgtaactaaaagttactaaacttaccgtacctaccccttacttaccttaccgggtttaccgggaaccgggtaacgggtaaacccgtaaaggggttcggaaacgtaaacgtaccgtaaaaacggtcgtacgggttaccgg

SEQ ID NO: 425985 - DNA, 622 bp, Homo sapiens
  misc_feature: GZ8MTXP02JU6TU.25.4.A04.1.454.CMB.2.raw
  modified_base (221)..(221): a, c, t, g, unknown or other
  modified_base (271)..(271): a, c, t, g, unknown or other
  modified_base (342)..(342): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacgttggccggngagtcgagggcattagctaattattagcctggtatacaaacagaaaccgngggatagttccaagctcctgatctatgctgcctacacgttacaccgtcgacgggtcccattcgtcggttcnggtccgatagtagaatcgtaggactagtacgttcactcactacgtacacagtcacggtccctaggacctacgtaccctaggtaaaagtgttacgggttaacgtaaccctttaaaattttacgtttaaacccgttaggtttaaaacctttaaaaaggttttacgaaacgttaacgggttaccgttaacccggttagggtaacgttcgggttaacccgggaccgtaacggggtaaccgaaggggtacgaacctaacgttaacgaaacggtacgtggtaccgg

SEQ ID NO: 425986 - DNA, 605 bp, Homo sapiens
  misc_feature: GZ8MTXP02IURK7.25.4.A04.1.454.CMB.2.raw
  modified_base (255)..(255): a, c, t, g, unknown or other
  modified_base (276)..(276): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgtttaaaaggtgtccaatgtgaggtgcaactggtggagtcgtgggggagcttggtacagccaggccggtcctgacactctcctgcacngccttccggactcaccttggngagcatgctatgaccgtgggtcccgccaggcctccgaaggggaacggtctgggagtgggtcgttggggttcagttagaaagcgaagcctagtgggtaggggacaaacacagtaccgccgacgtactaggtaaaaacggcaagtattcacgtccctactacgaaagagagttagaacttaacccgaaaaagcaactccgtaccttaatctcgaccacagtagagcgaacgccgtagaacgaacggacggaggactcgacgtccggtagttaactttacgttagtttaacgtttaactttacttcgtaggtaaggtaggttaggtttaagg

SEQ ID NO: 425987 - DNA, 682 bp, Homo sapiens
  misc_feature: GZ8MTXP02G6XZH.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacagccagggccgtccctgacactctcctgcacagccttccggactcaccttggtgagcatgctatcgaccgtgggtccgccagggcctaccggaaggggaacgggtcgtagggaggttgggtccgtttggggttacaagtttaggaaacggtcggaaacgtccgtaggtggggtacggggacaaacgaacagtaccgccggtcgtacgtaaggtaaaacggcaaagtacttacacgtccctactacgaaagagtagtacgaacttaacccgaaaaagtccaaacgttccgtaccttaacttctacgaccaacgataggacgaccgaacgtcccgtagaaggaacggaccgggtaacgggacctaccggacggtacccggttagttaactttaccgttagtttaaccgtttaagttaaccttcggtaggtaacggttaacggtttaacggttttaagg

SEQ ID NO: 425988 - DNA, 614 bp, Homo sapiens
  misc_feature: GZ8MTXP02HT5U0.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggaggcttggtacagccaggccgtccctgacactctcctgcacagcttccggactcaccttggtgagcatgctatcgaccgtgggtccgccagggcctccgaggggaagggtcgtgggaggtggtcgtttggggttcagttagaaggtcgaacgccttagtggggtggggacaaaccgacacgtacggacccgtcgttaccgtaaggtaaaaacgggcaagtacttcaacgtccctactacgaaagagatagacttaccaaaagcaatccgaccttattctacgcaacagtgacgcaacgccaggaacgaaagcggaacggactacgaacggtcccgttagttaactttaccttgtttaacctttattaacttcgtaggtacgttaggtttagtttaacgg

SEQ ID NO: 425989 - DNA, 639 bp, Homo sapiens
  misc_feature: GZ8MTXP02GSN6P.25.4.A04.1.454.CMB.2.raw
  modified_base (271)..(271): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagccttggtatcaacagaaaccaggganagttccaagctcctgatctatcgctcgcctacctacgttacaccgtacgacgggtcctacgttcgtccggttacgcgggcgtacgtacgtagaagtcggtagggactagtacgttaccactcctactacttacacgacgacgacgtccgtacgacgtacgtacgtaaggtaagtgtttacgttactaactttaaacgtttacgttaacgttaaacgttaaaactaaaacgtttaacttaaaccgttacccttacccgttacccttaccgttaccggttaccgggttaccggggaacggggtaaaccgggtaaacgggtaagggtaacggtaaacgtaaccgtaaaacgtaaacggtacggtcggtacg

SEQ ID NO: 425990 - DNA, 566 bp, Homo sapiens
  misc_feature: GZ8MTXP02JS696.25.4.A04.1.454.CMB.2.raw
  modified_base (281)..(281): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagccttccggactctaccgtttggngagcatgctatcgacctgggtccgccagggcctccgaggggaaggtctgggagtggcgttggggtcagttaggaagcgaacgcctagtgggtacggggacaacgacacgtaccggcccgacgtactaaggtaaaaggcaagacttcacgtccctctacgaagagatacgaattaccaaaagcatccgacctagtctagacacatgagcagccgtagagaagcggaggactcgacgcgttcgtacttacgtagttcttacttactcgtagagtacgttagtttagg

SEQ ID NO: 425991 - DNA, 556 bp, Homo sapiens
  misc_feature: GZ8MTXP02HLBXK.25.4.A04.1.454.CMB.2.raw
  modified_base (217)..(217): a, c, t, g, unknown or other
  modified_base (261)..(261): a, c, t, g, unknown or other
  modified_base (266)..(266): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttgccggnagtcaggcattagcaattattagctggtatcaaacagaaaaccnggganagttccaaagctctgatctatgctcgctccactacacctcacgggtccactctcgttcacgcgcagtagaagtcgtggacgagagttacactcttacaaccttaactacacgacacgacctacgacacgtacgtacgtaagtagttagttacgtactaaacttaacttaacttaacgtaaactaaaagtaaaataaaacttaactaccgtaccctacctacgtacgttacggtacggaacggaacggtaacggtaggaacgtaacgaaacgtaaacgtaacgtacgtacg

SEQ ID NO: 425992 - DNA, 513 bp, Homo sapiens
  misc_feature: GZ8MTXP02GKW27.25.4.A04.1.454.CMB.2.raw
  modified_base (270)..(270): a, c, t, g, unknown or other
  modified_base (330)..(330): a, c, t, g, unknown or other
  modified_base (391)..(391): a, c, t, g, unknown or other
  modified_base (397)..(397): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccaggganagttcctaagctcctgatctatgctgcctcacgttacacctcagggtcccatctcgttcngcgcagtgaatcgtgggacagagttcactctcactatcagctagccctgcagcctagagtntgttanactaacttattactagtacaaaagtataatactcgtccctctactacgtttccggacgggtacgggaaccgaagggttacggaagacgttaaccgaaaacggtaccgtaggtcggg

SEQ ID NO: 425993 - DNA, 592 bp, Homo sapiens
  misc_feature: GZ8MTXP02IB9ZS.25.4.A04.1.454.CMB.2.raw
  modified_base (278)..(278): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgtcttttccttgttgcttgttttaaaggtgtccaatgtgaggtgcaactggtggagtcgtgggggaggcttggtacagccaggccggtccctgacactctcctgcacagccttccggactcaccgtttggngagcatgctatgaccgtgggtcccgccaggcctccgaggggaagggtctgggagtggtcgtttggggttcagttaggaagcgaaagtcccctagtggggtcggggacaaacacgaatcccgccggacgttacgtaaggtaaaacggcaagtacttcacgcctctacaagaagatagaacttaaccaaaagtcaagtccgtaccttatcgtgactacatagacgcacgccagagaaggcgacggactcgacgtccgttgttacttacgttatttactttaacttactcgtaggtagtaggttagttacggtttaa

SEQ ID NO: 425994 - DNA, 662 bp, Homo sapiens
  misc_feature: GZ8MTXP02H60IS.25.4.A04.1.454.CMB.2.raw
  modified_base (288)..(288): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaacatggagtttgggcttaactgttctttttccttgttgcttagttttaaaaggtgtccaatgtgaggtgcaacgtggtggagtcgtggggggagtcgttggtacagccgagggcccggtcctgacactctcctgcacagccttccggactctaccgtttggngagcatgctagtcgaccgtgggtcccgcgaggccgtccggaggggaacgggtcgtgggaggtggtcgtttgggtttacagttaaggaagcggaagtccccgtagtggggtacgggacaaacacgaacgtccggccgtcgtacgttaaggtaaaacgggcaagtacttaccgacgccttactacgaaagagtatagtaacttaacccgaaaagtctaacgtaccgtacccttaagttctacgaccaacgtacgtagacgacgacgtacgtaggaacggaacggacggaacggacgtacgacgtccgttagttactttacgttcgtttacttaacgttacgtacgttaggtaagttaggtttagtttacggtttaa

SEQ ID NO: 425995 - DNA, 524 bp, Homo sapiens
  misc_feature: GZ8MTXP02IRAXA.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtctgggggaggcttgggtacagccagggccggtccctgacactctcctgcacagcttccggactcacctttggtgagcatgctatgacctggggtcccgccagggctccgaggggaagggtctgggagtgggctttggggttcattagaagcgaagcctagtggtggggcaaacacatacgccgcgtctagtaaaaggcagattcagcctctcaagagatgattaccaaaagcaatcgcctatctgcacatgagcagcctgagaagcgaggactcaagccgtgtattactgttcttattactctgacgtagtagtttagg

SEQ ID NO: 425996 - DNA, 583 bp, Homo sapiens
  misc_feature: GZ8MTXP02H2YKT.25.4.A04.1.454.CMB.2.raw
  modified_base (362)..(362): a, c, t, g, unknown or other
  modified_base (390)..(390): a, c, t, g, unknown or other
  modified_base (467)..(467): a, c, t, g, unknown or other
  modified_base (474)..(474): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccagggccggtccctgacactctcctgcacagccttccggactcaccttggtgagcatgctatgacctgggtccgccaggcctccgaggggaaggtctggagtggcgtttggggttcagttagaaagtcgaagcctagnggggtagggcaaacgacaagtacgccgngtactagtaaaagcaagattcagcctctacaagagatagaactaccaaaagcataccgacctatctgacacatgganacagccngaagaagcggaaggtacacgaggcccgttagtaactttaaccgttgtttactttaacttaaccgttcgtaaggaggtaaggtttacggttaggttttaacttttaaacg

SEQ ID NO: 425997 - DNA, 715 bp, Homo sapiens
  misc_feature: GZ8MTXP02JRNLM.25.4.A04.1.454.CMB.2.raw
  modified_base (286)..(286): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgtgcttaactgttcttttccttgttgcttagttttaaaaggtgtccaatgtgaggtgcaactggtggagtcgtgggggagcgttggtacagccgaggcccgtccctgacactctcctgcacagtccttccggactctaccgtttgggngagcatcgtctagtcgaccggtcggtccgccgacggtccgtacggaggggtacggtcgtagggtaggttcgggttcgttgggttactaagttaacggaagtacgtaacgtccgtaggtcggggtacgggaacaacgaacgtacgtaccggccgtacgtacgtaaaggtaaacggctaagtactacgacgtcctacgtaacgaaagtagtagtaacgtaaaccgtaaaccgaaaacgtcctaaccgtaccgtaccttacgtcgtacgacctaagacgtacggaacgacgacggtacgtaagggaaacggaacggtaccggacggtacctaccggtacggttaccgtttacgttaaccgtttacgtttacgtttaaccgtttaacgtttaccgttacggtaggtaacggtttaacggtttaaggtttaacg

SEQ ID NO: 425998 - DNA, 533 bp, Homo sapiens
  misc_feature: GZ8MTXP02FJ18O.25.4.A04.1.454.CMB.2.raw
  modified_base (295)..(295): a, c, t, g, unknown or other
  modified_base (337)..(337): a, c, t, g, unknown or other
  modified_base (377)..(377): a, c, t, g, unknown or other
  modified_base (410)..(410): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcagggcattagcaattatttagcctggtatcaaacagaaaccgagggagagttcctaaagctcctgatctangctgcctccacgttacacctcgaggggtcccatctcggttcngcggcagtgaatcgtgggacagagttcactctcacttacncacgcacgcctgacacgactagaagtattgtanacttaacttattactagtaataaaagttataaactactccgtacccttactaccgtacggttacgggacggtaacgggaacgtaagggtaggaacgtactaaccgaaaacgtacgtaggtacg

SEQ ID NO: 425999 - DNA, 515 bp, Homo sapiens
  misc_feature: GZ8MTXP02H69HB.25.4.A04.1.454.CMB.2.raw
  modified_base (257)..(257): a, c, t, g, unknown or other
  modified_base (388)..(388): a, c, t, g, unknown or other
  modified_base (397)..(397): a, c, t, g, unknown or other
  modified_base (401)..(401): a, c, t, g, unknown or other
  modified_base (414)..(414): a, c, t, g, unknown or other
  modified_base (438)..(438): a, c, t, g, unknown or other
  modified_base (445)..(445): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcagttagacaatttattagcctggtancaaacgaagaaaccgagggatagtttaccaaatctacctgattctatgctcgcctaccacgttacaccgtcgacgggtccagtcgtcggtcagtcgacagtagaatcgaggacagtactcactcacactancagcacgcngcanctgaatatgttanactaacttatactataacaaatanaatctcnccctctacgtacgttacggacggtaacggaccgaagggtagaacgtaacaaccgaaaagacgttagccgg

SEQ ID NO: 426000 - DNA, 523 bp, Homo sapiens
  misc_feature: GZ8MTXP02IMXWG.25.4.A04.1.454.CMB.2.raw
  modified_base (217)..(217): a, c, t, g, unknown or other
  modified_base (271)..(271): a, c, t, g, unknown or other
  modified_base (336)..(336): a, c, t, g, unknown or other
  modified_base (346)..(346): a, c, t, g, unknown or other
  modified_base (407)..(407): a, c, t, g, unknown or other
tcagactgtacagtcacgaccggtgctcgatttagagtagtgatcagggggcagaagtctctctcagtcaggacacagcatgtacatgagggtccctgctcagctcctgggactcctgctgctctggctcccagataccagatgtgacgtccagatgacccagtctccatcctcctgtctgcatctgttggagacagaatcagcatcacttgccggngagtcagggcattagcaattatttagcctggtatacaaacagaaaccgaggganagttacctaagctcctgatctatgctgcctccacgttacactcgacggggtcccatcgtcgttcnggtcgcagtnaatcgtagggacagtgtccactctcactatcagcagcctgacagtcctagagtattggtanacctaattattactacgtaataaaatataaattaacgttcgaccccttcttacgacgtttccgggacgggtaacggaccgaagggttacgagtactaacgaaacgtacgtagtcgg

SEQ ID NO: 426001 - DNA, 532 bp, Homo sapiens
  misc_feature: GZ8MTXP02GHVR9.25.4.A04.1.454.CMB.2.raw
  modified_base (271)..(271): a, c, t, g, unknown or other
  modified_base (335)..(335): a, c, t, g, unknown or other
  modified_base (373)..(373): a, c, t, g, unknown or other
  modified_base (383)..(383): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcaagcatcacttgccgggcagtcagggcattagcaattatttagcctggtatcaaacagaaaccaggganagttcctaagctcctgatctatgctgcctccacgttacacctcgaggggtcccatctcggttcngcgcagtgatcgtgggacagagttcactctacactacncagcacgccncgacgacgacgtagtagtagtagtagtactaacttaacttactacgtaactaaagtaattaactactaccgtaccctacctacgttacgttacggtacggaacggaacggtaaggtacggaacgtacgtaacgtaacgtacgtacgtcg

SEQ ID NO: 426002 - DNA, 494 bp, Homo sapiens
  misc_feature: GZ8MTXP02IMCGC.25.4.A04.1.454.CMB.2.raw
  modified_base (193)..(193): a, c, t, g, unknown or other
  modified_base (218)..(218): a, c, t, g, unknown or other
  modified_base (270)..(270): a, c, t, g, unknown or other
  modified_base (343)..(343): a, c, t, g, unknown or other
  modified_base (368)..(368): a, c, t, g, unknown or other
  modified_base (380)..(380): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttgccgggngagtcagggcattagcaattattagcctggtatacaacagaaaccgaggganagttcctaagctcctgatctatgctcgcctccacgttacacctcgaggggtcccatctcggttcagcgcagtnatgtgggacagagtcactctcatancagcagcctgcngcctagaagtatgtagactaacttattactagtactaaaagtataatactcgaccctctacacgtttcggacggtacggacgaaggtggaactacgacgaaacgtagtgtacgg

SEQ ID NO: 426003 - DNA, 596 bp, Homo sapiens
  misc_feature: GZ8MTXP02FRARV.25.4.A04.1.454.CMB.2.raw
  modified_base (474)..(474): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggagcttggtacagccaggccgtccctgacactctcctgcacagcttccggactcacctttggtgagcatgctatcgacctgggtccgccaggcctccgaaggggaggtctgggagtgggtcttggggttcagttaggaagcgaacgcctagtggggtacgggacaacgacagtaccgccgcgtactagtaaaaggcaagattcacgtcctactacaaagagatagaacttaccaaaagcatccgacctatcctgaccaanagtagacgacgacgcgagaagaacgtacggaacggacgtacgacggtaccgttacgttaactttacgttacgtttaactttacgttacgttacgtaggtaagttaacggtttaggtttaacg

SEQ ID NO: 426004 - DNA, 621 bp, Homo sapiens
  misc_feature: GZ8MTXP02JUTX0.25.4.A04.1.454.CMB.2.raw
  modified_base (195)..(195): a, c, t, g, unknown or other
  modified_base (222)..(222): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttgganacagaatcagcatcacgttggccgggngagtcgagggctattagactaattatttacgccttaggtatacaaacgaagaaaccgagggatacgttccaagctccgtagactctatgactgctactcctactttcgactaagtttcggggtcccttctcgtattcgaggcggtacgtagggtcgggtcgtaggggaactaagtaacttccaccttcctaccaaccctactccgaacgccgacgtccctgacctacggtacccgttaggaagtacgttggttacgaaccttaaacgtttacttaacgtagttaaacttaaaaagtttcgaacgtacggtacggtaccggttggtaacgttcggtaccgggacccgtaacggggaaccgtaagggtacgaactacgtaacgaaacgtaacgtaggtcgg

SEQ ID NO: 426005 - DNA, 604 bp, Homo sapiens
  misc_feature: GZ8MTXP02GFCRX.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggaggcttggtacagccaggcccggtccctgaccactctcctgcacagccttccggactcacctttggtgagcatgctatgaccgtcgggtccgccgaggcctccgaggggaagggtcgtggaggtggtcgtttggggttcagttagaagcgaagcctagtgggtgggacaacacaatacgccgcgtctaggtaaaagcaagattcacgcctctacaaagagatagattaaccaaaagcaactcgacctatctcgcacaatgaacgcacgccgtagaaggaaacgcggaacggacctacgacggtacccgttaggttaactttaccgttacgtttactttaacttaacttcgtaggtaaggtaacggtttaggtttacggtttaattttaaacg

SEQ ID NO: 426006 - DNA, 495 bp, Homo sapiens
  misc_feature: GZ8MTXP02FO1OV.25.4.A04.1.454.CMB.2.raw
  modified_base (220)..(220): a, c, t, g, unknown or other
  modified_base (334)..(334): a, c, t, g, unknown or other
  modified_base (345)..(345): a, c, t, g, unknown or other
  modified_base (390)..(390): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttgccgggnagtcagggcattagcaattatttagcctggtatcaacagaaaccagggagagttcctaagctcctgatctatgctgcctccacgttacacctcgacggggtccatctcggttcngcgcagtgatngggacagagttcactctcactatcagcagcctgcagcctagaagnttgtgactaacttattactagtacaaaagtataaatactcgccctctactactttcggacggaggaaccgtaaggtcggaagactacgaaaacgacgtagtacgg

SEQ ID NO: 426007 - DNA, 674 bp, Homo sapiens
  misc_feature: GZ8MTXP02J3VKZ.25.4.A04.1.454.CMB.2.raw
  modified_base (281)..(281): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggaggcttgggtacagccaggccggtccctgacactctcctgcacagcttccggactcacctttggnagcatgctatgacctgggtccgccaggctccgagggaaggtctggagtggcttgggtcagttagaagcgaagcccctagtgggtacggggacaacacgaaagtccggcccgacggttactaagggtaaaaacgggcaaaggtacttccaaacgtcccttaccgtacgaaaaggagtagtagtaaacgtttaacccaaaaaacggcctaaactcccggtaccttactcctgactaaccaagtgaacgaccgaacgtcccgtaggaaacgaaacggacggtaacgggacctaccggaaacggtcccgttaaggttaactttaaccgttcgttttaccctttaattaaacccgtcgttacggtaaggtacggtttaacggtttaggttttaaaacg

SEQ ID NO: 426008 - DNA, 485 bp, Homo sapiens
  misc_feature: GZ8MTXP02JK8H6.25.4.A04.1.454.CMB.2.raw
  modified_base (328)..(328): a, c, t, g, unknown or other
tcagactgtacagtcacgaccggtgctcgatttagagtagtgatcagggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcagtcagggcattagcaattattagcctggtatcaacagaaaccagggagagttcctaagctcctgatctatgctgcctcacgttacacctcaggggtcccatctcggttcngcggcagtgaatctgggacagagttcactctcactatcagcagctgcagcctgagatgtgcactattactgtactaaataataataactatccctcctcctacttacgtcggtacggaccgaaggtacggacgagtacgaacgaaccgtacgtacgg

SEQ ID NO: 426009 - DNA, 491 bp, Homo sapiens
  misc_feature: GZ8MTXP02I1EK1.25.4.A04.1.454.CMB.2.raw
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacacctcaggggtcccatctcggttcngcgcagtgaatcgtgggacagagttcactctcactatcagcagcctgcagcctagaagatgttgacaacttattactgttacaaaagtataataactcgaccctctctacgtttcggcggtacggaccaaggtcgacgactacaaacgaactgtacgg

SEQ ID NO: 426010 - DNA, 578 bp, Homo sapiens
  misc_feature: GZ8MTXP02J102M.25.4.A04.1.454.CMB.2.raw
  modified_base (276)..(276): a, c, t, g, unknown or other
  modified_base (298)..(298): a, c, t, g, unknown or other
  modified_base (417)..(417): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttgggacagccaggccggtccctgacactctcctgcacagcttccggactcaccttggtnagcatgctatgacctgggtccnccaggctccgaggggaggtctggagtggcttgggttcagttagaagcgaagcccctagtgggtggggacaacacaatcgccgacgtctagtaaaaggcaagattcagtcctctacaagngatgaacttaccaaaagcaatcgacctatcctgacacatagacgacgacgccgtagagaagacggacggacgtacgacgtaccgtacggttacttacgttacgtttactttaacgtttacttaccgttacgtaggtacggttaacggttaggttttaaacg

SEQ ID NO: 426011 - DNA, 590 bp, Homo sapiens
  misc_feature: GZ8MTXP02J1WN0.25.4.A04.1.454.CMB.2.raw
  modified_base (417)..(417): a, c, t, g, unknown or other
  modified_base (448)..(448): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggtcttggtacagccgaggcccggtccctgacactctcctgcacagctccggactcacctttggtgagcatgctatcgacctgggtccgcaggctccgaggggaggtcgtgggagtggcgttgggtctagttagaagcgaagcctagtgggtggggacaacacagtacgccgcgtctagtaaaagcagattcagtcctctanaagagatagtacttaacgaaaagtcagtccncctagtctagactacatggacgcacgccgtaggaagaacgaccggagaccgcgaacgtcccgggttattaaccgtttaccgtttagtttaaccgtttaactttaccgttacgttaggtaacggttacggtttaggttttaag

SEQ ID NO: 426012 - DNA, 521 bp, Homo sapiens
  misc_feature: GZ8MTXP02GPODJ.25.4.A04.1.454.CMB.2.raw
  modified_base (404)..(404): a, c, t, g, unknown or other
  modified_base (409)..(409): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagctaattattagcctggtatacaacagaaaccagggagagttccaagctcctgatctatgctcgcctccacgttacaccctcgacgggtcccattctcggttcagcgcagtgaatcgtagggacagtgttcactctcactatcagactacgcctgacacgcctgaagtntgttnacttaacttattactagtaactaaaagtataaacttacctcgtacccctctacctacgtttcgggacggaaggtaccgaaggtcgaacgactacgaaacgtacgtagtacgg

SEQ ID NO: 426013 - DNA, 539 bp, Homo sapiens
  misc_feature: GZ8MTXP02IQSZC.25.4.A04.1.454.CMB.2.raw
  modified_base (274)..(274): a, c, t, g, unknown or other
  modified_base (297)..(297): a, c, t, g, unknown or other
  modified_base (403)..(403): a, c, t, g, unknown or other
tcagactgtacagtcacgaccggtgctcgatttagagtagtgatcaggggctgggagaggagccccagccgtgagattcccaggagtctccacttggtgatcagcactgaaaacagaccaccaaccatggagtttgggcttaactgtcttttccttgttgcttgtttaaaggtgtccaatgtgaggtgcaactggtggagtcgtgggggaggcttggtacagccaggcccggtccctgacactctcctgcacagcttccggactcacctttggngagcatgctatgacctgggtccnccaggctccgaggggaagggtctggagtggcttgggttcagttagagcgagcctagtggtggggcaacacaatacgccgcgtctagtaaaaggcagattcagcctntcaagagatgattaccaaaagcaatcgcctatctgcacatgacgcgagcctgaagaagcgaggactcacggtccgtgttaacttcgttgtttctttattactcgtagtagtagttagttggtttatttactttaac

SEQ ID NO: 426014 - DNA, 557 bp, Homo sapiens
  misc_feature: GZ8MTXP02HSS5E.25.4.A04.1.454.CMB.2.raw
  modified_base (298)..(298): a, c, t, g, unknown or other
  modified_base (318)..(318): a, c, t, g, unknown or other
  modified_base (377)..(377): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggccggtccctgacactctcctgcacagcttccggactcacctttggtgagcatgctatgacctgggtccnccaggctccgagggaggtcnggagtggctttgggtcattagagcgaagcctagtgggtggggcaaacacaatacgccgngtctagtaaaaggcagattcagcctctacaagagatagacttaccaaaagcaatcgaccttatctgacacatgagcaacgccagaagacgacgacgactcgacgccgtagttacttacgttctttactttacttaaccgttctaggtaggtaagtttaggttacggtttaattttaaacg

SEQ ID NO: 426015 - DNA, 581 bp, Homo sapiens
  misc_feature: GZ8MTXP02IZAZC.25.4.A04.1.454.CMB.2.raw
  modified_base (274)..(274): a, c, t, g, unknown or other
  modified_base (300)..(300): a, c, t, g, unknown or other
  modified_base (379)..(379): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtggggggaggcttggacagccaggccggtccctgacactctcctgcacagcttccggactcacctttggngagcatgctatcgaccgtgggtcccnccgagggcctccggaaggggagggtctgggagtggctttggggttcagttagaagcgaagctagtgggtgggacaacanaagtaccgccgtgtactagtaaaacggcaagatttcacgtcctctacaaagagatagacttaccaaaagcatcgaccttatctgactacagtagacgcaacgcctaggagaagcgaacggactcgaacggtccgttagttactttacgtcgtttactttattaacgtcgtagacggtagttagttaggtttaattttaaacg

SEQ ID NO: 426016 - DNA, 525 bp, Homo sapiens
  misc_feature: GZ8MTXP02IX680.25.4.A04.1.454.CMB.2.raw
  modified_base (278)..(278): a, c, t, g, unknown or other
  modified_base (301)..(301): a, c, t, g, unknown or other
  modified_base (400)..(400): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttgggtacagccaggccggtccctgacactctcctgcacagcttccggactcacctttggngagcatgctatgacctgggtccncaggctccgagggaggtctggagtggcttgggtcattagaagcgaagcctagtggtggggcaacacatcgcgcgtctagtaaaaggcagattcagcctntcaagagatagacttaccaaaagcaatccgacctatctgcacatgagcagcctagagaagcgaggactcgagtccgtagtacttacttcgttaacttacttacctctaggagtagttagtttagg

SEQ ID NO: 426017 - DNA, 609 bp, Homo sapiens
  misc_feature: GZ8MTXP02JZ91K.25.4.A04.1.454.CMB.2.raw
  modified_base (322)..(322): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccagggccggtccctgacactctcctgcacagcttccggactcacctttggtgagcatgctatgacctgggtccgcaggctccgaggggaggtcngggagtggcgttgggtcagttagaagcgaagcccctagtggggtggggacaacgacaacgtccggccgtcggtactagtaaaaggcaaggacttacgagcccttactacgaaagagatagtaactttacccgaaaaagccaattccggacccttatccgtgaccaaccagtgagccaagtccaggaagaaggaccggaagggtaccacggacggtacccggttagtaactttacgttgtttacctttaagttacttacgtagtaagtaggttagttacggttttaaa

SEQ ID NO: 426018 - DNA, 584 bp, Homo sapiens
  misc_feature: GZ8MTXP02HAS6K.25.4.A04.1.454.CMB.2.raw
  modified_base (271)..(271): a, c, t, g, unknown or other
  modified_base (337)..(337): a, c, t, g, unknown or other
  modified_base (345)..(345): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcgagggcattagcaattattagcctggtatacaacagaaaccaggganagttcctaagctcctagatctatgctgcctccacgttacacctcgacgggtcccagtctcggttcngcgcagtnatcgtgggacagtagtcactctacactatcagcacgcctgacacgtcctaggaagtattggttacgaccttaaactttactttaacgtacgttaaacctaaaaagttacttaaacttaaccggtacccgtaacccccttcgttaaccgttaccggtttccggggaaccgggttaacggggaacccgtaaggggttaccggaagtaacgtaacgtaaaaccggtacgttacggtaaccgg

SEQ ID NO: 426019 - DNA, 565 bp, Homo sapiens
  misc_feature: GZ8MTXP02IQNDF.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccaggcccggtccctgaccactctcctgcacagccttccggactctacctttggtgagcatgctatgacctggtcccaccaggctccgaggggaggtctgggagtggcgttggggttcattagaagcgaacgcctagtgggtggggcaaacacagtaccgccgcgtctaggtaaaaggcaagattcagccctctacaagagatagacttaccaaaagcaatccgactatctgcacatgagcagcctagagaagcgaggactacgacgtccgtagttaacttacgtttagtttcctttaagtttaccttacgtaggtaaggtagttaaggttttagg

SEQ ID NO: 426020 - DNA, 501 bp, Homo sapiens
  misc_feature: GZ8MTXP02H2K9L.25.4.A04.1.454.CMB.2.raw
  modified_base (194)..(194): a, c, t, g, unknown or other
  modified_base (269)..(269): a, c, t, g, unknown or other
  modified_base (401)..(401): a, c, t, g, unknown or other
  modified_base (415)..(415): a, c, t, g, unknown or other
tcagactgtacagtcacgaccggtgctcgatttagagtagtgatcaggggcagaagtctctctcagtcaggacacagcatggacatgagggtccctgctcagctcctgggactcctgctgctctggctcccagataccagatgtgacgtccagatgaccccagtctccatcctccctgtctgcatctgttgganacagaatcagcatcacttgccgggcagtcagggcattagcaattattagcctggtatcaaacagaaaccaggganagttctaagcctctgatctatgctgcctccacgttacacctcgacggggtccatctcggttcagtcggcagtgaatcgaggtaccagtagttcactctcactatcagcagcctgccagcctgaagatggtanactaacttattacngtaacaaagtaataactactcgtccctctctaactttcggacggtacggaccaaggtgaacgactacgaaaaccggtacttagcgg

SEQ ID NO: 426021 - DNA, 590 bp, Homo sapiens
  misc_feature: GZ8MTXP02JR93V.25.4.A04.1.454.CMB.2.raw
  modified_base (295)..(295): a, c, t, g, unknown or other
  modified_base (315)..(315): a, c, t, g, unknown or other
  modified_base (459)..(459): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggacagccaggccggtccctgacactctcctgcacagccttccggactcaccttggtgagcatgctatgacctgggtccnccaggctccgagggaggtcnggagtggctttgggttcagttagaagtcgaaagcctagtgggtggggacaaacacaaagtacggccgcgtactagtaaaaaggcaagattcagtccctactcaagagatgtataccaaaagcaatcgacctatcctgacactanagagacgacgccgagagaagacggacggaaccgtcgacggtacccgttacgttaacgtttaacgttcgtttactttacgttaacgttaccttcgtacggtaagttacggtttacggtttacgttttaaacg

SEQ ID NO: 426022 - DNA, 733 bp, Homo sapiens
  misc_feature: GZ8MTXP02GXA8U.25.4.A04.1.454.CMB.2.raw
  modified_base (193)..(193): a, c, t, g, unknown or other
  modified_base (220)..(220): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgtgganacagaatcagcatcacgttggccgggngagtcgagggctattagctaatttattacgccttaggtaactacaaacgaacggaaaaccgaggggaagtaacggtttacctaaaggccttacctggtaacttccttaagtcggtaccttccggtccccttacccgtaaaccggtttacctaaccccggttccggaaccgggggttaccccctacggtttcccggttaccgggtttaccgacggggtccgggtactaggggttacgtaaacggttcggttacgggggaactaacgggtactttacccaacgttcctactaacttactccgaacgccgaacgtccgtcgacgtaccgtacgtagtaagttagttacggttactaactttaaactttaacgttaacgttaacgttaaaacgttaaaagttaacttaaacttaccgttacccgttaccctttaccgttaccgttaccggttaccggggaacggtaacggaacggtaacggtacgaaacgtaacgtaacgaacgtacggtcggtacg

SEQ ID NO: 426023 - DNA, 693 bp, Homo sapiens
  misc_feature: GZ8MTXP02HM3PT.25.4.A04.1.454.CMB.2.raw
  modified_base (306)..(306): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccagggcccggtccctgacactctcctgcacagcttccggactctacctttggtgagcatgctatgaccgtgggtcccncgacgggcctccggaaggggtaaggtcgtgggaggttgggtcgtttgggttcagttagaagcgaacgtcctagtggtggggacaaacacacgtacgccgactaccgtaaggtaaaacggctaaggacttacacgtccctacgtacgaaaggtagtaacgtagtaactttaacccgaaaaaacgcctaaacgttacccggtaccctttaacttcccggttacgaccctaaaccaagttaggacggaccgtaacggtcccgtaagggaacggaaaacggcccgggtaaaggaaaccgtccgaacggtacccgtttaggttaacttttaaccgtttgtttaacctttaagttaactttccgtaggtacggttagttttaaacggtttagg

SEQ ID NO: 426024 - DNA, 684 bp, Homo sapiens
  misc_feature: GZ8MTXP02G61ZY.25.4.A04.1.454.CMB.2.raw
  modified_base (274)..(274): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtcctgacactctcctgcacagcttccggactcaccttttgggngagcatgctagtcgaccgtggccgccgaggcctcggaggggaggtcgtgggaggtggtcgtttgggtactagttaaggaacgtacgaacgtccgtaggtggggtacgggacaaacgaacgtaacgtaccggccgtacgttacgtaaaggtaaaacgctaagtacttaccgacgtcctactacgaaagagtaagttacgtaacttaaaccgaaaacgtacctaacgtaccgtaccttactccgtacgactaacgtagtacgacgacgacgacgtaggaacggaacggacggtaacggtaccgtacggacggttaccggtttagttaacgtttacgtttacgtttaactttaacgttaacgttacgtaaggtaacggttacggtttaaggtttacggtttaaactttaaacg

SEQ ID NO: 426025 - DNA, 590 bp, Homo sapiens
  misc_feature: GZ8MTXP02GTQLT.25.4.A04.1.454.CMB.2.raw
  modified_base (279)..(279): a, c, t, g, unknown or other
  modified_base (302)..(302): a, c, t, g, unknown or other
  modified_base (326)..(326): a, c, t, g, unknown or other
  modified_base (361)..(361): a, c, t, g, unknown or other
  modified_base (387)..(387): a, c, t, g, unknown or other
  modified_base (485)..(485): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgtttaaaaggtgtccaatgtgaggtgcaactggtggagtcgtggggggagcttgggtacagccaggccggtccctgacactctcctgcacagcttccggactcacctttggngagcatgctatgacctgggtccnccagggcctccgaggggaaggtcnggagtggcttgggtcagttagaagcgaagcctagngggtggggacaacgacataccgccgngtaccgtagtaaaacggcaagattcgaacgtcctactacgaaagagaatacgtaacttaccgaaaaagctaaacgtccgacctactcctagacacagngagcgacgaccagagaaggacggacggacgtacgacgaccgtacgttattaacgttacgttaacgtttactttacttacgtagtacgtaacggttaggtttaagg

SEQ ID NO: 426026 - DNA, 568 bp, Homo sapiens
  misc_feature: GZ8MTXP02H2IMX.25.4.A04.1.454.CMB.2.raw
  modified_base (278)..(278): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagcttccggactcaccgtttggngagcatgctatcgacctgggtcccgcaggcctccgaggggaacggtctggagtggctttgggtcagttagaagcgaagccctagtggtgggtacaaacacaatccgccgtcgtactaggtaaaaaggcaaagacttacacgcctactacaaagagatagaacttaccaaaaagcaactaccgaccttatctgacacaatgacgcacgcctaggaagaacgacgacggaactcgaacgtccgtagtacttactgtttacttaattactcgtagagtagtagttagtttaac

SEQ ID NO: 426027 - DNA, 535 bp, Homo sapiens
  misc_feature: GZ8MTXP02JJU4F.25.4.A04.1.454.CMB.2.raw
  modified_base (278)..(278): a, c, t, g, unknown or other
  modified_base (301)..(301): a, c, t, g, unknown or other
  modified_base (432)..(432): a, c, t, g, unknown or other
  modified_base (468)..(468): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttgggtacagccaggccggtcctgacactctcctgcacagcttccggactcacctttggngagcatgctatgacctgggtccnccaggctccgaggggaaggtctggagtgggcttggggttcagttagaagcgaaacgcctagtggtaggggcaaacgacacgtaccgccggcgtactaggtaaaagggcaaggtacttcagcctctcaaganatgattacaaaagcaatcgactatctgctacatgancagcctagagagcgaggactcgagccgtagtacttctagttctattactcgtgacgtagtagtttag

SEQ ID NO: 426028 - DNA, 625 bp, Homo sapiens
  misc_feature: GZ8MTXP02GT3NM.25.4.A04.1.454.CMB.2.raw
  modified_base (298)..(298): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagttggcttaactgttcttttccttgttgcttagttttaaaaggtgtccaatgtgaggtgcaactggtggagtcgtgggggaggtcttggtacagccgaggcccggtccctgacactctcctgcacacgtcttcccggactcctaccgttggtgagcatgctancgaccgtggtcccgccaggcctcggaggggacggtcgtggaggtggtcgtttgggttcagttagaagcgaacgctagtgggtgggacaaacacacgtaccgccgcgtacgaagtaaaacggcaagtattcacgccctcgtacaaagagatagaacttaacccgaaaagcaacgtccgacctatcgtacgactaacatacggacgccgaacgccgtaggaacgaaacggtaccggaacggaccttacgacggtaccgttagttaacctttaccgttagtttaactttacttaccgttacgtaggtaacggtaggtttagtttaaacgg

SEQ ID NO: 426029 - DNA, 703 bp, Homo sapiens
  misc_feature: GZ8MTXP02G234C.25.4.A04.1.454.CMB.2.raw
  modified_base (219)..(219): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttggccgggngagtcgaggcattagactaattattagacctggtatacaacaagaaaccgaggagtacgttactaagctcctagatctatcgtctcgcctcctacgttactacccgtaccgtaggggtcccccccccctagttccgttccggttacgacggtccggacgtaaggtacgtaacgttacgtacggggaaccgtaggtacgtttaccgtaccgttaccttacctaacttacgtaccacggtaccaacggacccttcgaaccgcgtaccgtaacggtaacgtaagttagggtttaccgtaacgttaaacctttaagtttaaccttaaggttaaaaccgtaaaagttaaaacttaaacgttaacccgttaaccgtacccccttccttacccgttaccggtttaccgggtaacccggggaacgggtaaacccggtaagggttaggtaaaccggtaagtaaaccgaaaacggtaaccgtaaggttaaccgg

SEQ ID NO: 426030 - DNA, 559 bp, Homo sapiens
  misc_feature: GZ8MTXP02FR39W.25.4.A04.1.454.CMB.2.raw
  modified_base (361)..(361): a, c, t, g, unknown or other
  modified_base (431)..(431): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacttcggccggcgagtcgagggctagttagactaattatttagccgtaggtactacaaacgaacgaaaccgagggactacgttacctaaggctcctagtactctatcgctcgccctacctacgttacaccgtcgacggtcctatcgtcggttncgcgactagtcagtcgtagggacagtacgttccatcactactatccagcacgcctgactcgactagagtntagttacacttaattagttactaacgtaataaaagtacttaactaccgtaccgtacccttagtccgttacggttaccgggacggtagaaccggtaaggtgaaacgtacttaccgaaagtacgtgacgg

SEQ ID NO: 426031 - DNA, 664 bp, Homo sapiens
  misc_feature: GZ8MTXP02JNPXG.25.4.A04.1.454.CMB.2.raw
  modified_base (276)..(276): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagccttccggactcacctttgggnagcatgctagcgaccgtggccgcgagctacggagggaggtcgtggagtggtcgttgggtacagtaggaagcgaagtcgtagtgggtacgggacaaacgacaacgtaccggccgtacgttacgtaagggtaaaacgcgtaaggtacttaccgacgtcccttacgtacgaaaggtacgtaagttacgtaaacttaaaccgaaaacgtcctaacgtaccgtaccttaagtccgtacgacctaacgtagtacggacgaccgacggtaccgtaggaacggaacggacggaacggtacctacgacggtaccgttagttaacgtttacgttacgtttacttaacttaacgtacgttaggtaacggttaggttacggtttacggtttaactttacg

SEQ ID NO: 426032 - DNA, 729 bp, Homo sapiens
  misc_feature: GZ8MTXP02IH0TY.25.4.A04.1.454.CMB.2.raw
  modified_base (287)..(287): a, c, t, g, unknown or other
tcagactgtacagtcacgaccggtgctcgatttagagtagtgatcaggggagctctgggagaggagcccccagccgtgagattcccaggagtcttcacttggtgatcagcactgaacacagaccaccaaccatggagtttgggcttaactgttcttttccttgttgcttgttttaaaaggtgtccaatgtgaggtgcaactgggtggagtcgtgggggagcttgggtacagccaggcccggtccctgacactctcctgcacagtccttccggactcaccttttgggngagcatcgctagtcgtaccgtcgggtcccgccgacggccgtaccggaaggggtaggtcgtaggggtaggttcgggtcggtttgggtactaaagttaaggaaacggtacggaacgtaccgttaggtcggggtacggggaaccaaaccgaacgtacgtacccgccggtaccggttacgtaagggtaaaacggctaaagtacttacgacgtaccctacgtaacgaaagtagtaacgttagtaacttaaaccgaaaacgtcctaacgtacccgtaaccttaacgttccgtacgaccaacgtagtacggacgtacgaacgtaccgtaggaaacggaacggacggaacggtaccgtacgtacggtaccggttagtttaaccgtttacgtttacgtttaacgtttaactttaccgttacgtaaggtacggttaacggtttaaggtttag

SEQ ID NO: 426033 - DNA, 663 bp, Homo sapiens
  misc_feature: GZ8MTXP02HC6UK.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccaggccggtcctgaccactctcctgcacagtccttccggactctaccgtttggtgagcatgctagtcgaccgtgggtcccgccagggcctccggaaggggtaacggtcgtgggaggttcgggtcgtttggggttcaagttaacggaagtcgaacgtccgtagtggggtacggggacaaacgaacgacgtaccggccgacggttacgtaaggtaaaaacggctaagtacttccaacgtccctacgtacaaagagatagtaacttaaccgaaaagccaaacgttccgacctaattccgtagacctaacagtaggacgacgaacgcccgtaagaacgaacggacggtaacgggacctacgaacggtcccgttaagttactttacgtttacgtttaaccttagttaccttgtaggtaaggtacggtttaggtttaag

SEQ ID NO: 426034 - DNA, 737 bp, Homo sapiens
  misc_feature: GZ8MTXP02JU50O.25.4.A04.1.454.CMB.2.raw
  modified_base (276)..(276): a, c, t, g, unknown or other
tcagactgtacagtcacgaccggtgctcgatttagagtagtgatcagggggctctgggagaggagcccagccgtgagattcccaggagtctccacttggtgatcagcactgaacacagaccaccaaccatggagtttgggcttaactgtcttttccttgttgcttagttttaaaggtgtccaatgtgaggtgcaactggtggagtcgtgggggagcttggtacagccaggccgtcctgacactctcctgcacagcttccggactctaccgtttggngagcatgctagtcgaccgtgggtcccgccgaggcctccggaggggtaacgggtcgtaggggaggttggtcgtttggggttacaagttaaggaagcggtaaagccccgtaggtggggtacggggaccaaacgacgtaacgtacccggccggtacggttaccgtaagggtaaaaacgggcctaaggtactttaccaaacggtcccttaccgtacgaaaaggtagtaacttacggtaaactttaaccgaaaaacggtcctaaacgttcccggaacccttaacgttccttacggaacctaaccgaaagttgggaaacgccgtaacggtacccgtaggaaaggaaaacgggttccggaaacgggtaccttacgaaacgggtcccgttagttaaaccgtttcgtttacggtttctttaaacgttccttacgtacggtaaggtacggtttacggttacgtttttaaac

SEQ ID NO: 426035 - DNA, 521 bp, Homo sapiens
  misc_feature: GZ8MTXP02GK8HF.25.4.A04.1.454.CMB.2.raw
  modified_base (275)..(275): a, c, t, g, unknown or other
  modified_base (338)..(338): a, c, t, g, unknown or other
  modified_base (413)..(413): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttggccgggcgagtcagggcattagctaattattagcctaggtatcaaacagaaaaccaggganagttccaagctcctgactctatgctcgcctcacgttacacctcgacgggtccatctcggttcncgcgcagtgaatcgtagggactagagttcactctcactatcagcacgcctggcctacgcctagaagcttggttanactaacttatactagtaacaaaagtataaactactcgtaccctactactaccgttcggacggaacggaccgaaaggtcggaagactaacgaaacgtaacgtggtacgg

SEQ ID NO: 426036 - DNA, 563 bp, Homo sapiens
  misc_feature: GZ8MTXP02IO7EM.25.4.A04.1.454.CMB.2.raw
  modified_base (535)..(535): a, c, t, g, unknown or other
tcagactgtacagtcacgaccggtgctcgatttagagtagtgatcaggggctgggagaggagccccagccgtgagattcccaggagtctccacttggtgatcagcactgaacacagacccaccaaccatggagtttgggcttaactgttcttttccttgttgcttgttttaaaaggtgtccaatgtgaggtgcaactggtggagtcgtgggggagcttggtacagccaggccggtccctgacactctcctgcacagcttccggactctacctttggtgagcatgctatgacctgggtccgccaggctccgaggggaggtcgtggagtggctttgggttcattagaagcgaaagcctagtgggtcgggcaaacataacgtacgccgtcgtctaggtaaaaacggcaaggtattcagtcctctacaagagatagaacttacaaaagcaactccgaccttaactctgacaccatagacgcacgctagagaagcgaggaactcgagtccttagtactttactcgtttacttattaactntagtatagttagtttgtttaactttaac

SEQ ID NO: 426037 - DNA, 568 bp, Homo sapiens
  misc_feature: GZ8MTXP02G60FQ.25.4.A04.1.454.CMB.2.raw
  modified_base (193)..(193): a, c, t, g, unknown or other
  modified_base (220)..(220): a, c, t, g, unknown or other
  modified_base (349)..(349): a, c, t, g, unknown or other
  modified_base (395)..(395): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatcctcctgtctgcatctgtgganacagaatcagcatcacgttggccgggnagtcgagggctagttagactaatttattagcctaggtatacaaacaagaaaccgagggagtagttaccaagcctcctgatctatgctcgcctcacgttacaccgtcgacgggtcccatcgtcggttacnggcgctagtagaagtcgtaggacagtacgttacactctacacttanccagcaacgtccagacacgtacctagtaaagtcttggtactacttaaactttattactagtaaactaaaagttactaaacttaccgtactaccccttattacccgtacgtttaccggggacggtaacgggaaccgtaaggtcggaagtaactaacgaaaacgacgttaggacg

SEQ ID NO: 426038 - DNA, 584 bp, Homo sapiens
  misc_feature: GZ8MTXP02IJFW1.25.4.A04.1.454.CMB.2.raw
  modified_base (281)..(281): a, c, t, g, unknown or other
  modified_base (304)..(304): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactgggtggagtcgtggggggagcttgggtacagccaggcccggtcctgacactctcctgcacagcttccggactcacctttggngagcatgctatgacctgggtccncagggcctccgaggggaaggtctggagtggctttgggtcagttagaagcgaacgcctagtgggtggggcaaacacagtccgccgcgtactaggtaaaaggcaagattcacgcctctcaaagagatgaattaccaaaagcatccgactatctgcacagtgacgcgacgtccgtagaaaggaacgacgggaaacggacctacgaacggtcccgttagttaacctttacgttagtttaacctttaattacttcgttaggtacggttaagtttaggtttaacgg

SEQ ID NO: 426039 - DNA, 604 bp, Homo sapiens
  misc_feature: GZ8MTXP02I02IA.25.4.A04.1.454.CMB.2.raw
  modified_base (303)..(303): a, c, t, g, unknown or other
  modified_base (392)..(392): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgaccactctcctgcacagccttccggactctacctttggtgagcatgctatgacctggtccncaggctccgagggaggtctggagtggtcttgggttcagttaggaagcgaagcctagtgggtcggggactaaacacagtaccgacccggngtaccgtaggtaaaaacggcaggtaattcagacccttcacaagaagtatgtaacttaacccgaaaaagcaagtacccgtaccttaacttccgtacgaccaaaccgacgtagacgcgaaacgtcccgtagaagacgaccggaggaactcgagtccgttagtaactttcttgtttaacttactttactacgtaggacgttagttaggttttagg

SEQ ID NO: 426040 - DNA, 692 bp, Homo sapiens
  misc_feature: GZ8MTXP02JMSRX.25.4.A04.1.454.CMB.2.raw
  modified_base (282)..(282): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagttgggcttaactgtcttttccttgttgcttgttttaaaaggtgtccaatgtgaggtgcaacgtggtggagtcgtgggggaggcttgggtacagccagggcccggtccctgacactctcctgcacagcttccggactctaccttggngagcatgctagtcgaccgtgggcccgccaggcctccgaggggaacggtctgggagtgggtcgttgggttcaagttaggaagcgaaacgccgtagtgggtcggggacaaacgacacgtaccgccgcgtaccgtaaggtaaaaacgggcaaggtactttaccgaacgtccctacgtacgaaaagagtaactaggtaaaccttaaccgaaaaagcctaaagttccgacccttaagtccgttacgacctaactaagtacggaacgacgaacggtaccgtaagggaaacggaaacgggaccggtaacggtaccgtacggtaccggttaccggttacgtttaactttacgtttacgttttaacctttaacgtttaccgtacgttaaggtaacggtttaacgggtttagtttaacgg

SEQ ID NO: 426041 - DNA, 830 bp, Homo sapiens
  misc_feature: GZ8MTXP02JMZ3Y.25.4.A04.1.454.CMB.2.raw
  modified_base (282)..(282): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttgggtacagccagggcccggtccctgacactctcctgcacagcttccggactctacctttggngagcagtgctagtcgaccgtcgggtcccgccgagggtccctaccggaaggggtaacggggtcgtaggggaggttcggggtccggtttggggttactaaggtttaacggaaaggtccggtaaaacggtccccgttaaagggtcggggttacgggggaccaaaaccgaacgtaacgtaacccgggcccggtacggttaccgtaaagggtaaaaacgggcctaaagggtactttccgaaacggtccccttacgtaaccgaaaaggtagtaagtacggtaaaccttaaaccgaaaaaacgcctaaacgtcccggtaaccctttaactaccgttcggaaccgtaaaccaagttacggaacgtacgtaaacggccccgttaaggggaaaagtaaacggggaccgggtaaacggggaacccttaccggaacgggttaccccggtttaagtttaaacccggttttaactttaaggttttaaacgtttttaaccttttaacccgttacggtttaaggttaaacggttaaacgggtttttaacggtttttaaaccggg

SEQ ID NO: 426042 - DNA, 648 bp, Homo sapiens
  misc_feature: GZ8MTXP02H52A9.25.4.A04.1.454.CMB.2.raw
  modified_base (348)..(348): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcgagggcattagctaaattattagcctaggtatacaaacaagaaaccgagggaacagttcctaagctcctgatctatgctgccctccacgttacaccgtcgacggggtcccagtccttcggttcnggcggacaggttagaactcggtagggactaacgtcgtactacctcttacaacttactacgacgtccaacgcctacgcgtaaccgaccgtaggtaaaggtaagttgtttacggtaaccttaaaacgtttaactttaaaccgtaaggtttaaacctaaaaaagtttaaactaaaactttaacctaaccgttccccttacttaaccgtaccggttttaccggggaaccggggttaaccgggaaccgtaaaggggttacggaaaggtaacgttaaaccgaaaacggtaaacgttacggtacggg

SEQ ID NO: 426043 - DNA, 520 bp, Homo sapiens
  misc_feature: GZ8MTXP02JPKTO.25.4.A04.1.454.CMB.2.raw
  modified_base (281)..(281): a, c, t, g, unknown or other
  modified_base (304)..(304): a, c, t, g, unknown or other
  modified_base (362)..(362): a, c, t, g, unknown or other
  modified_base (412)..(412): a, c, t, g, unknown or other
  modified_base (450)..(450): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttgggtacagccaggcccggtccctgacactctcctgcacagcttccggactcacctttggngagcatgctatgacctgggtccnccaggctccgaggggaaggtctgggagtgcgttgggtcattagagcgaagctagtggngggcaacacatcgcgcgtctagtaaaacggcagatcagcctctacaaganatagaacttaccaaaagcaatcgctatctgcacatgancagcctgagaagcgagactcacgccgttagtacttacgtgttcttaattactctagagtagttagtttag

SEQ ID NO: 426044 - DNA, 537 bp, Homo sapiens
  misc_feature: GZ8MTXP02HZ79M.25.4.A04.1.454.CMB.2.raw
  modified_base (278)..(278): a, c, t, g, unknown or other
  modified_base (301)..(301): a, c, t, g, unknown or other
  modified_base (400)..(400): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggccggtccctgacactctcctgcacagcttccggactcacctttggngagcatgctatgacctgggtccnccaggctccgagggaggtctggagtggcttgggttcagttagagcgaagccctagtgggtggggacaacacaatcggccgcgtctagtaaaaggcaagnttcagcctctcaagagatagattacccaaaagcactcgcctatctagcacatgagcagcctgagagcgaggactcgacgccgtagttacttacttgtttacttaagttcctgttagagtagttagttacggttttaa

SEQ ID NO: 426045 - DNA, 548 bp, Homo sapiens
  misc_feature: GZ8MTXP02FP565.25.4.A04.1.454.CMB.2.raw
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgaccgtgggtccgccaggctccgaggggaaggtctgggagtggcgttgggttcattagaagcgaagtcccctagtgggtggggacaacgacaagtccgccgcgtactaggtaaaagcaagattcagccctctacaagagatgaattaccaaaagcatcgacctatctgacacatgacgcacgctagaagagcgaaggactacgacgtaccgttgtacttactcgtttcttaattactcgtagagtacgtagtagttttaa

SEQ ID NO: 426046 - DNA, 570 bp, Homo sapiens
  misc_feature: GZ8MTXP02JJU1Y.25.4.A04.1.454.CMB.2.raw
  modified_base (220)..(220): a, c, t, g, unknown or other
  modified_base (273)..(273): a, c, t, g, unknown or other
  modified_base (335)..(335): a, c, t, g, unknown or other
  modified_base (339)..(339): a, c, t, g, unknown or other
  modified_base (375)..(375): a, c, t, g, unknown or other
  modified_base (389)..(389): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcgagggcattagcaattatttagcctggtatcaaacagaaaccaggganagttcctaagctcctgatctatgctgcctcacgttacacctcgagggtcccatcgtcgttcngcgnagtgaatcgtagggacagtagttcactctcacttancagcagcctgaccngcctagaagtatgttacgacttaaactttattacgtagttaactaaaaagttataaaacttacgtaccgtaccccttacgttaccttaaccggtttacggggaccggggttaacggggtaaacccgaaagggttacgggaaaacgtacgttaaacgaaaacggtaaacgttcggtaacggg

SEQ ID NO: 426047 - DNA, 621 bp, Homo sapiens
  misc_feature: GZ8MTXP02IL02X.25.4.A04.1.454.CMB.2.raw
  modified_base (306)..(306): a, c, t, g, unknown or other
  modified_base (367)..(367): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcttggtacagccaggccggtccctgacactctcctgcacagcttccggactctaccgtttggtgagcatgctatgacctgggtccncgaggctccgaggggaggtctggagtggtcgttgggtcaagttagaagcgaacgccgtagngggtgggacaaacacagtaccgccggctacgtaagtaaaacggctaaggattcgaacgtccctactacgaaagtagaattagaacttaaacccaaaaagtctaaacgtccgtacctaagttcctgacaacagtcggaacgcagccgaggaaacggaaacggcggaaagggtaccacgacggtaccgttacgttactttacttacgtttaatttaacgttaccttacgtagtacggtaacgtttaggttttaagg

SEQ ID NO: 426048 - DNA, 613 bp, Homo sapiens
  misc_feature: GZ8MTXP02JPDNM.25.4.A04.1.454.CMB.2.raw
  modified_base (282)..(282): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccaggcccggtcctgacactctcctgcacagccttccggactctacctttggngagcatgctagtcgaccgtcggggtccccgccgacgggtcctaccggaaggggtaacggttcgtgggtaggttggtcgtttgggttcagttagaagtcgaacgcctagtgggtcgggacaacacagtacgccgacgtctaaggtaaaagctaagattcacgtcctactacgaaagagatagaacttaacgaaaacgcctaactccgaccttactctacgtacacgtagtgacgacgacgtcccgtagaacgaacggacggaaggcctacgacggtaccgtagttaacgttcttgtttaacttagttactcgtagtagtacgtttagtttag

SEQ ID NO: 426049 - DNA, 566 bp, Homo sapiens
  misc_feature: GZ8MTXP02JMMK2.25.4.A04.1.454.CMB.2.raw
  modified_base (306)..(306): a, c, t, g, unknown or other
  modified_base (482)..(482): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccagggccggtccctgacactctcctgcacagccttccggactctacctttggtgagcatgctatgacctgggtccnccgaggcctcgaggggaaggtcgtgggagtgggcgtttggggttcagttaggaacgtcgaaacgcctaagtggggtggggacaacgacacgtacgccgtcgtacgtagtaaaaggcaagtatcagtcctctacaagagatgacttaccaaaagcactcgctatctagcacatgacncacgtccagagaagcggtagactcgaacgccgtagtactttaactgttctttaacgtacttacgagtacgtaggttatttacgg

SEQ ID NO: 426050 - DNA, 587 bp, Homo sapiens
  misc_feature: GZ8MTXP02GVDAH.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccagggccggtccctgacactctcctgcacagccttccggactcaccttggtgagcatgctatgacctgggtccgccaggcctccgaggggaaggtcgtggagtggtcgtttgggtcagttagaagcgaacgccgtagtgggtggggacaacgacatacgccgcgtcgtagtaaaacgcaagattcagtccctctacaagacgtatagtaacttaccaaaagcaactccgtacctactctagacacagtagagcagccgtagaacgaacggcggacggactcgaacggtccggttagttacgtttaccttagtttcctttaacttacttcgtaggtaacggttaggttaaggttttacgg

SEQ ID NO: 426051 - DNA, 521 bp, Homo sapiens
  misc_feature: GZ8MTXP02IE7JV.25.4.A04.1.454.CMB.2.raw
  modified_base (500)..(500): a, c, t, g, unknown or other
tcagactgtacagtcacgaccggtgctcgatttagagtagtgatcaggggctgggagaggagccccagcccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggtgagcatgctatgacctgggtccgccaggctccgagggaggtctggagtggcttggggttcattagaagcgaagcctatggtggggcaacacaatacgccgcgtctgtaaaagcagattcagcctctcaagagatgattaccaaaagcatcgcctatcctgcacatgagcagcctgagaagcgaaggactcgagccgtagtattactgtttcttattaactctagngagttagttagtttactttaa

SEQ ID NO: 426052 - DNA, 548 bp, Homo sapiens
  misc_feature: GZ8MTXP02JJF3I.25.4.A04.1.454.CMB.2.raw
  modified_base (281)..(281): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccaggcccggtccctgacactctcctgcacagcttccggactcacctttggngagcatgctatcgaccgtgggtcccgccaggcctccgaggggaaggtctgggagtggcgttgggttcagttagaagcgaacgcctagtgggtggggacaacgacactaccgccgcgtcgtagtaaaaggcagattcagcctactacaagagatgaactacaaaagcatcgcctatctagccacatgagcacgcctagagaagacggacggctacgacgtccgtagtacgttacttgttaactacttactcttagagtagtagtttag

SEQ ID NO: 426053 - DNA, 508 bp, Homo sapiens
  misc_feature: GZ8MTXP02GQA7P.25.4.A04.1.454.CMB.2.raw
  modified_base (218)..(218): a, c, t, g, unknown or other
  modified_base (293)..(293): a, c, t, g, unknown or other
  modified_base (332)..(332): a, c, t, g, unknown or other
  modified_base (393)..(393): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccgggngagtcagggcattagcaattatttagcctggtatcaaacagaaaccagggagagttcctaagctcctgatctatnctgcctcacgttacacctcgacgggtccatctcggttcngcggcagtgaatcgtgggacagagttcactctcatatcagcacgcctgcagcctgaaacgntgttagactaacgtttatactagtaacaaaagtataactactacgtaccccttctactacgtttccgggacggtaacgggaccaagggtcgaagacgtacaaaacgtactgacgg

SEQ ID NO: 426054 - DNA, 617 bp, Homo sapiens
  misc_feature: GZ8MTXP02G85KF.25.4.A04.1.454.CMB.2.raw
  modified_base (309)..(309): a, c, t, g, unknown or other
  modified_base (427)..(427): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtccaatggtggagtcgtgggggagcttgggtacagccagggcccggtccctgacactctcctgcacagccttccggactccaccgtttggtgagcatgctatcgaccgtgggtcccnccgtaggcctccgagggaggtctggagtggcttgggtcagttagagcgaagccctagtgggtgggacaacgacaaatccggccgtcgtactagtaaaaggcaagtacttcgagccctntacaagagagtagaacttaaccgaaaagcaactcgaccttatctgcactagtgacgcgaacgccgtagaaggaacggacggaacgaaccgtacgaccggttacccggttagtttaactttaccgtttcgttttactttaacgtttacttacgttacggtaagtaacggtttagtttacgggtttttaaaa

SEQ ID NO: 426055 - DNA, 555 bp, Homo sapiens
  misc_feature: GZ8MTXP02F7W3R.25.4.A04.1.454.CMB.2.raw
  modified_base (280)..(280): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttgggtacagccagggccggtccctgacactctcctgcacagccttccggactctacctttggnagcatgctatcgaccgtgggtcccgccgaggctccgaggggaagggtctgggagtggcgttggggtcagttagaagcgaagccctagtgggtggggacaacacaaatccggccgcgtactagtaaaaggcagattcagccctctacaagagatgtaacttaccaaaagcaatccgacctatctgacacagtagagcagcctgaagaacgcgacggactcgacgtccgtagtacttactgtttacttaagttactcgtgagtagtagttgtttaac

SEQ ID NO: 426056 - DNA, 552 bp, Homo sapiens
  misc_feature: GZ8MTXP02HGFNC.25.4.A04.1.454.CMB.2.raw
  modified_base (300)..(300): a, c, t, g, unknown or other
  modified_base (320)..(320): a, c, t, g, unknown or other
  modified_base (450)..(450): a, c, t, g, unknown or other
  modified_base (458)..(458): a, c, t, g, unknown or other
  modified_base (461)..(461): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggcccggtccctgacactctcctgcacagcttccggactcacctttggtgagcatgctatgaccgtggtccncaggctccgaggggaggtcnggagtggctttgggtcagttagagcgaagcccctagtgggtgggacaaacacgaatcgccgtgtcctagtaaaaggcagacttcagccctctacaaagacgatagattacccgaaagcaatccgacctanctgaccanagngacgacacgcaggacgacgcgacggactacgacgtcgttatacttacgttgtttacttaattcgtacgtagagtagttagtttagtttaac

SEQ ID NO: 426057 - DNA, 722 bp, Homo sapiens
  misc_feature: GZ8MTXP02JDO67.25.4.A04.1.454.CMB.2.raw
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttgggtacagccagggcccggtccctgacactctcctgcacagccttccggactctaccgtttggtgagcatcgctagtcgaccgtgggtcccgccgaggctccgaggggaacggtctggtaggtggtcgtttgggtactagttagaagcgaagccccgtagtgggtacggggacaacgaacaactccggccgacggttacgtaagggtaaaacggctaaaggtactttacgaacggtcccttacgtaacgaaaggaagtaagttacggtaaactttaaacccgaaaaaagcctaacgttacccggtacccttaaattccgttacgaccaactaagtcggaacggaccaaacgggccctaagggaaaggaacgacggttaaacgggaaccgttcgaccgggttacccgttaggtttaacttttaacccgttggtttttaacccttaagttttacccttacgttaaggtaacgttaacgggtttacggtttaacggtttttaaac

SEQ ID NO: 426058 - DNA, 608 bp, Homo sapiens
  misc_feature: GZ8MTXP02IJQVO.25.4.A04.1.454.CMB.2.raw
  modified_base (220)..(220): a, c, t, g, unknown or other
  modified_base (371)..(371): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacgttggccgggngagtcgagggcaattagactaatttattagcctaggtaatacaaacaagaaaccgagggatacgtttaccaagcctacgtagactctagtcgtcctcgaccctaccgtaacgttacacccgtaccgacgggtccctagtcgttacggttcncgggtcgactagtacgtaacgtcggtagggacaagtacgtacctactctactactatcacgcacgcctgacgacgactaggaagtgttggtacacttaaacttattaactagtaaactaaaagttactaaaacttcctaccgtaccccttacttaccgttaccggtttccggggaacggtaacggtaaccgtaaagggtcgaaacgtacgtaaaacgaaacgtaacgttggtaccgg

SEQ ID NO: 426059 - DNA, 510 bp, Homo sapiens
  misc_feature: GZ8MTXP02HKMPA.25.4.A04.1.454.CMB.2.raw
  modified_base (329)..(329): a, c, t, g, unknown or other
  modified_base (351)..(351): a, c, t, g, unknown or other
  modified_base (398)..(398): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccgggcagtcagggcattagcaattattagctggtatacaacagaaaccagggagagttcaagctctgatctatgctgcctcacgttacacctcgacgggtcccatcgtcggttcnggcgcagtgaatcgaggacagngttcactctacactatcagcacgcctgcagcctagaagattggttanactaaatttacttactagtaactaaaagtataaactactacgtccctactacgtacgtttcgggacggtaacggaccgtaaggtggaactacgacgaaacgtacgtagtcgg

SEQ ID NO: 426060 - DNA, 514 bp, Homo sapiens
  misc_feature: GZ8MTXP02F6GE0.25.4.A04.1.454.CMB.2.raw
  modified_base (220)..(220): a, c, t, g, unknown or other
  modified_base (342)..(342): a, c, t, g, unknown or other
  modified_base (404)..(404): a, c, t, g, unknown or other
  modified_base (453)..(453): a, c, t, g, unknown or other
tcagactgtacagtcacgaccggtgctcgatttagagtagtgatcagggggcagaagtccctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacttggccgggngagtcagggcattagctaattattagcctggtatacaaacagaaaccgaggagtagttcctaagctcctgatctatgctgccctcctacgttacactccgacgggtccatcgtcgtcagcgnagtgaatcgtaggatagtagttcacctcactactatcagcacgcctagcacgcctagaagtntagttgactaacttattactagtaataaaagtataactactcgtccctntacctacgttcggacggacggaccgaagggtgaagaactacgaaacgtactggtacgtacg

SEQ ID NO: 426061 - DNA, 510 bp, Homo sapiens
  misc_feature: GZ8MTXP02JHXV3.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgcatctggttggagacagaatcagcatcacttggccgggngagtcgagggcattagcaattattagcctggtatcaacagaaaccagggagagttcctaagctcctgatctatgctcgcctccacgttacaccctcacggggtcccatctcggttcaggtcgcagtgaatcgtagggacagtagttcactctctactatccagcagcctgcagctgagatgttgactaacttatactgtaacaaaagtataataactcgtcccctactctacgtttcgggacggtacgggacgaaggtggaagtacgtacgaaacgtaacgtgtcgg

SEQ ID NO: 426062 - DNA, 655 bp, Homo sapiens
  misc_feature: GZ8MTXP02HZDJC.25.4.A04.1.454.CMB.2.raw
  modified_base (276)..(276): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccgtcctgacactctcctgcacagcttccggactcaccgtttggngagcatgctagtcgaccgtcgggtcccgccgacggccgtaccggaaggggtacggtcgtagggtaggtcggtcggtttgggtactaagttaaggaacgtacggtaaccgtaccgttaggtggggtacggggaacaaaccgaacgtaacgtaccggccgtacgttacgtaaaggtaaaacggctaagtactacgaccgtccctactaacgaaagtagtacgtacgtaaactaaccgaaaagtcaacgtccgaccttacgtcgacgaccaagagtagacgacgtacgacctaggaacgaacgcggaacggtacacgtacggtcgttatacgtttacgttacgtttaactttatacgttcgtagtaaggtagtttaacggtg

SEQ ID NO: 426063 - DNA, 680 bp, Homo sapiens
  misc_feature: GZ8MTXP02IPODC.25.4.A04.1.454.CMB.2.raw
  modified_base (278)..(278): a, c, t, g, unknown or other
  modified_base (283)..(283): a, c, t, g, unknown or other
  modified_base (307)..(307): a, c, t, g, unknown or other
  modified_base (325)..(325): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggcctccagataccagatgtgacgtccagatcgacccagtcctccactccctccctgtctgcatctggttggagacagaatcagcatcacgttggccgggcgagtcgaagggctattagactaattattagcctaggtatacaacagaaaccngggangttaccagctctagatctatgtcncgtccctaccacgttacncccgtaccgacggggtcccctagtccgttccggttaccaggggtccggtactaagggttagtaaaccgttcggaacgggggtaacctaggggttacgttaccctaccttaccggtcctaaaccgtttaaaccgtaccgaacgtaccgacgtacccgtacgaccgtaaccggtaccgtaaggtaacgttacgttacgtaaccgtaacctttaaacgtttaacttaacgttaaacgttaaacgttaaaacttactaacgttaccctcccgtacccttacgttaccgttacggttacgggaaccggtacggaaacgtaagggtacggaataacgtacgtaaacggtacgtacggtacg

SEQ ID NO: 426064 - DNA, 533 bp, Homo sapiens
  misc_feature: GZ8MTXP02ITUMQ.25.4.A04.1.454.CMB.2.raw
  modified_base (220)..(220): a, c, t, g, unknown or other
  modified_base (335)..(335): a, c, t, g, unknown or other
  modified_base (408)..(408): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcagggcattagctaattattagcctggtatcaaacagaaaccgagggagagttccaagctcctgatctatgctgccttcacgttacactcgacgggtcccatctcggttcngcgcagtgaatcgtagggacagtagttcactctcatatcagcagcctgcagtcctagtaaagtgttaggttanactaaactttattaccgtaagttaactaaaaagttataaaacttacctacgccccttctaccgttacgtttcgggaccggtaggaccgaaaggttcgaacgaactacaaaacgtacgtagtacgg

SEQ ID NO: 426065 - DNA, 575 bp, Homo sapiens
  misc_feature: GZ8MTXP02FYZJF.25.4.A04.1.454.CMB.2.raw
  modified_base (277)..(277): a, c, t, g, unknown or other
  modified_base (300)..(300): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggaggcttggtacagccaggcccggtccctgacactctcctgcacagcttccggactcacctttggngagcatgctatgacctgggtccnccaggctccgaggggaaggtcgtggagtggtcgtttgggttcagttaggaagcgaaagcctagtgggtgggacaacacaatacgccgcgtactaggtaaaaggcaaggtacttcacgcctactacgaaagagatagacttaccgaaaagcaaacgtcgacctatctagccacatgacgcgacgccgtagaagaacgcggaaggactacgagtccgtagttacttacgttgttacttacttaacgtactagtacgtagtagttaggttactttaac

SEQ ID NO: 426066 - DNA, 488 bp, Homo sapiens
  misc_feature: GZ8MTXP02IV7BH.25.4.A04.1.454.CMB.2.raw
  modified_base (269)..(269): a, c, t, g, unknown or other
  modified_base (329)..(329): a, c, t, g, unknown or other
  modified_base (361)..(361): a, c, t, g, unknown or other
  modified_base (429)..(429): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcagtcagggcattagcaattattagcctggtatcaaacagaaaccagganagttccaagctcctgatctatgctgcctcacgttacacctcagggtcccatcgtcgttcngcgcagtgaatcgtagggacagagttcactcncactatcagcagcctgcagccagtagaatgtgactaactattactagtactaaataataataactacncctctactacttcgtacggacggacgaacggtagagacgacgaaacgaacgtagtacgg

SEQ ID NO: 426067 - DNA, 624 bp, Homo sapiens
  misc_feature: GZ8MTXP02GKXKR.25.4.A04.1.454.CMB.2.raw
  modified_base (275)..(275): a, c, t, g, unknown or other
  modified_base (299)..(299): a, c, t, g, unknown or other
  modified_base (321)..(321): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtcctgacactctcctgcacagcttccggactctacctttggngagcatgctatgaccgtgggtccnccaggcctccgaggggaggtcnggagtggcttgggtcagttagagcgaagccctagtgggtagggacaacgacaagtccggccgacgtaccgtaggtaaaacgggcaaagggtactttacaacggtccctactacgaaaggaagtatagtaactttaacccgaaaaagtccaacgtccgtacctaattccgtagaccaacagtacgacgcgaacgcccgtaggaacggaaggaccggaacgggaccttacgaacgtcccggttagttactttaccgttgtttacttaattactacgttaggtaggtagttaggtttagttttaaa

SEQ ID NO: 426068 - DNA, 545 bp, Homo sapiens
  misc_feature: GZ8MTXP02JVNCO.25.4.A04.1.454.CMB.2.raw
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaaacagaaaccagggagagttacctaagctctgatctatgctgcctccacgttacacctcgagggtcccatctcggttcngcggcagtgaatcgtgggacagagttcactctcatatcagcagcctgcacgtccagaactatcgtttagaccttaaactttaattaaccgtaggttaaccaaaaaggttactaaaacttaccgtacgtccccctacttccgtacgtttaccggggacgggaacgggtacccgaagggtacggaacgactaacgaaacgtaacgtcggtacgg

SEQ ID NO: 426069 - DNA, 574 bp, Homo sapiens
  misc_feature: GZ8MTXP02IUY68.25.4.A04.1.454.CMB.2.raw
  modified_base (218)..(218): a, c, t, g, unknown or other
  modified_base (341)..(341): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacttggccggngagtcgagggcattagctaattattagcctggtatacaaacaagaaaccgagggagagttacctaagctcctgatctatgctcgcctccacgttacacctcgacggggtcccatcgtcgttcnggcgcaggtgaatcgtagggacagtacgttcactactcactatcacgacacgcctaggacacggtacctaggtaagtaagttgttagacttaaacttaactttacgttaagtaaacctaaaaagttataaaacttaaccgtcctacccccttacttcctaaccggtttccgggacgggtaacgggaaccgtaagggggtcgtaagaacgtaccgaaaacggtaactggtacgg

SEQ ID NO: 426070 - DNA, 597 bp, Homo sapiens
  misc_feature: GZ8MTXP02FZLV1.25.4.A04.1.454.CMB.2.raw
  modified_base (278)..(278): a, c, t, g, unknown or other
tcagactgtacagtcacgaccggtgctcgatttagagtagtgatcagggggctccgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggcccggtccctgacactctcctgcacagcttcccggactcacctttggnagcatgctatgacctgggtccgccaggctccgagggaggtctggagtggcttgggttcagttagaagcgaagcctagtgggtgggacaacacaacgtacgccgcgtactaggtaaaacggcagattcacgcctactacaaagagatgacttacaaaagcaatccgacctatctcgacacagtagacgacgacgccgtaggaaggaacgcggacgggtaacctcggaacgtcccgttagttaactttaccttagtttaccctttaagttaacccttcgtacggtaacgtaggtttaaggtttacggtttaattttaaacg

SEQ ID NO: 426071 - DNA, 564 bp, Homo sapiens
  misc_feature: GZ8MTXP02HVQOP.25.4.A04.1.454.CMB.2.raw
  modified_base (376)..(376): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcctggtacagccaggccgtccctgacactctctgcacagcttccggactcacctttggtgagcatgctatcgacctgggtccgccaggctccgaggggaggtctgggagtgggcttggggtcagttaaggagcgaagcctagtgggtaggggacaacanagtacgccgcgtctaagaaaacggcagattcagcctctacaagagatgaacttaccaaaagcaatccgacctagtctagacacatgacgcagacctggaagaacggcggaaggcctacgacgtaccgtagttacttacgttagtttaactttaacgtttacctcgtagaaggtagtttaggtttaagg

SEQ ID NO: 426072 - DNA, 608 bp, Homo sapiens
  misc_feature: GZ8MTXP02GLOL3.25.4.A04.1.454.CMB.2.raw
  modified_base (358)..(358): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacgttggccgggcgagtcgagggcagttagactaattattagcctaggtatacaaacgaagaaaaccgagggaatacgttccaaagctcctagattctagtcgctcgcctaccaacgttacaccgtcgacgggtcccatcgtcggttcnggcgacagtagaatcgtagggacagtagttcactctacatactcagcacgcctgacgacgtcctagaaagtgttaggttactaaccttaaaactttatttaacctaaggttaaaccgtaaaaagtttaacttaaaacttaccttacccggtacccctttactaccgttaaccggtttaccggggaaacggggtaaccggtaaaccggaaagggtacggaataaacgtaacgaaaaacgtcgtaggtaccg

SEQ ID NO: 426073 - DNA, 542 bp, Homo sapiens
  misc_feature: GZ8MTXP02JA9FD.25.4.A04.1.454.CMB.2.raw
  modified_base (301)..(301): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttgggtacagccaggccggtccctgacactctcctgcacagcttccggactcacctttggtgagcatgctatcgacctgggtccnccaggctccgaggggaaggtctggagtggcgtttgggtcagttagaagcgaagccctagtgggtggggacaacacaatcgccgcgtctagtaaaaggcagacttcacgcctctacaagagatgattaccaaaagcatcgcctatctgcacatgagcacgcctagagaacgcgacggactcgacgtccgtagtacttacgtgtttaccttaagttcctcgtagagtagtacgttaggtttaa

SEQ ID NO: 426074 - DNA, 579 bp, Homo sapiens
  misc_feature: GZ8MTXP02G6RR9.25.4.A04.1.454.CMB.2.raw
  modified_base (194)..(194): a, c, t, g, unknown or other
  modified_base (220)..(220): a, c, t, g, unknown or other
  modified_base (272)..(272): a, c, t, g, unknown or other
  modified_base (333)..(333): a, c, t, g, unknown or other
  modified_base (373)..(373): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttggccgggnagtcgagggcattagcaattatttagcctggtatcaaacagaaaccaggganagttcctaagctcctgatctatgctgcctccacgttacacctcgagggtcccatctcgttngcgcagtgatcgtgggacagtagttcactctacacttacncacgcacgctagacacgtacgtagaagtgttagttacaacttaaacgtttacttaacgtaacgttaaacgtaaaagttaaacttaaaacttaccgtaccgtaccccttaccgttaccgttaaccggttaccggggaaccgggtaacgggtaaccggtaaagggtacggaaacgtaacgtaaaccgaaaacggttacgtacggtacg

SEQ ID NO: 426075 - DNA, 561 bp, Homo sapiens
  misc_feature: GZ8MTXP02IU229.25.4.A04.1.454.CMB.2.raw
  modified_base (255)..(255): a, c, t, g, unknown or other
  modified_base (276)..(276): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgacactctcctgcacngcttccggactcacctttggngagcatgctatcgaccgtgggtcccgccgaggcctccgaggggaagggtctgggagtggtcgtttgggtcagttagaagcgaagccctagtgggtgggacaacacaatcgccgcgtactagtaaaaggcaagtattcagtccctctacaagagatagacttaccaaaagcatccgacttatcctagacacatgacgtacacgcctaggaacgaacgcggaggactcgacgccgttagttacttacttgttacttaattactctagagtagttagtttgtttaaac

SEQ ID NO: 426076 - DNA, 709 bp, Homo sapiens
  misc_feature: GZ8MTXP02JZFQF.25.4.A04.1.454.CMB.2.raw
tcagactgtacagtcacgaccggtgctcgatttagagtagtgatcagggggctggggagaggagcccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggaggcttggacagccaggccggtccctgaccactcctcctgcacagccttccggactctacctttgggtgagcatgctatcgaccgtgggtcccgccgagggcctccggaaggggtaacggggtcgtgggaggtggtcgtttggggttactagttaggaaagcggaaagtccgtagtggggtggggacaaacgacaagtaccgccggcgtacgtaggtaaaagcaagtacttcacgtcctctacaagagatgtactaaccgaaaagcactccgtacctattctacgcaacgtagtacgacgaccgaacggtccgtaaggaacggtaaacgggacccgggaaaacggtaccggtacccgaacgggttaccccggggttaaattttaaccgtttaacgttaccggtttttaccttttaacgtttaacccgtttcgtaacggttaaacggggttaaaggttttacgggtttaaaccggttttaatttttaaaacccg

SEQ ID NO: 426077 - DNA, 575 bp, Homo sapiens
  misc_feature: GZ8MTXP02HRJSQ.25.4.A04.1.454.CMB.2.raw
  modified_base (303)..(303): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccaggcccggtcctgacactctcctgcacagccttccggactcaccttggtgagcatgctatcgacctgggtccnccaggctccgaggggaggtctggagtggcgtttgggtcagttagaagcgaacgcctagtgggtggggcaaacgacataccgccgcgttacgtagtaaaacggcaaggacttacacgtccctctacgaaagagatacgaacttaacccgaaaagccaagtccgacttagtctgaccacagtgagcacgcctagaacgaagcgaggacctcgacggtccgttagtactttactcgtttaacctttaattacctcgtagtacgtagttagtttag

SEQ ID NO: 426078 - DNA, 656 bp, Homo sapiens
  misc_feature: GZ8MTXP02JBHT7.25.4.A04.1.454.CMB.2.raw
  modified_base (193)..(193): a, c, t, g, unknown or other
  modified_base (337)..(337): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgtgganacagaatcagcatcacgttgccgggcgagtcgagggcatagcaattattagcctggtatcaacagaaaccgagggagagttacctaagctcctgtatctatgctcgcctccacgtacacctcgacggggtccatcgtcggttcngcgacagtgatcgtagggactagtgtcactctcatactcagcacgtcctgaccgacggaccctagggtaagtaacgtttcgggttacgtaacttaaacgttttaacgtttaacctaggtttaaaaccgtaaaaagtttaacttaaaacgtttacccgttacccgtaacccccgtttaccttaacccgtttaaccgggttttaccgggggaaaccgggggtaaccggggtaaaaccccgggttaaagggggttaacccgggaaaggttaaaaccgtttaaaccggaaaaaccggttaaaccggttacgggtttaccgggg

SEQ ID NO: 426079 - DNA, 503 bp, Homo sapiens
  misc_feature: GZ8MTXP02FR4OK.25.4.A04.1.454.CMB.2.raw
  modified_base (218)..(218): a, c, t, g, unknown or other
  modified_base (332)..(332): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggnagtcagggcattagcaattattagcctggtatcaaacagaaaccagggagagttcctaaagctcctgatctatgctgcctcacgttacacctcacggggtcccatctcggttcngcggcagtgaatcgtagggacagtagttcactctcactatcagcagcctgcagcctagagactgtgactaacttattactgtaacaaaagtataactactcgtaccctactactacgtttcggacggagggtaaccgaaggtcgaacgacgtacgaaaacgacgtgtacgg

SEQ ID NO: 426080 - DNA, 627 bp, Homo sapiens
  misc_feature: GZ8MTXP02F96IG.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacagccaggccggtcctgacactctcctgcacagccttccggactcacctttggtgagcatgctatcgaccgtgggtccgccgaggcctccggaggggaaggtcgtggagtggtcgtttggggttcagtttagaagcgaaagcctagtgggtcggggacaaacgacaacgtacggccgcgttacgtaggtaaaaacgctaagtacttcgacgcccttcgtacaaagagatagaacttaccaaaagcatccgaccttaatctagcaacagtagacgacgacgtccgaaggaagaacggcggaaggtacctaccgacggtcccgttaggttaactttacgtttacgtttctttaactttaaccttacgtaggacggttaggtttagtttaccggtttaatttttaaacg

SEQ ID NO: 426081 - DNA, 585 bp, Homo sapiens
  misc_feature: GZ8MTXP02GS181.25.4.A04.1.454.CMB.2.raw
  modified_base (197)..(197): a, c, t, g, unknown or other
  modified_base (350)..(350): a, c, t, g, unknown or other
  modified_base (409)..(409): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgcatctgttgganacagaatcagcatcacgttggccgggagagtcgagggcattagactaattattagctaggtatacaaacgagaaaaccgagggtagtacgttaccaagctacctgtatctatgctcgcctcacgttacacctacgcggtaccatcgtcggttnggtcgacagtagaactcggagggacagtattacactctactaactatacagcacgtccngacacgtactagtaatcgttacgtactaacttaaactttacttaagtaaacgtaaacgtaaaattaactaaccgtaccgtacccgtacccttacgttaccggttacggttacggggaacgggtaacgggaacgtaagggtacggaaactaaacgtaacgaaacgtacgtacgtacg

SEQ ID NO: 426082 - DNA, 666 bp, Homo sapiens
  misc_feature: GZ8MTXP02INFT2.25.4.A04.1.454.CMB.2.raw
  modified_base (280)..(280): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtcctgacactctcctgcacagtccttccggactctacctttggngagcatgctatcgaccgtgggtcccgccgagggcctaccggaaggggaacgggtcgtgggaggttgggtcgtttggggttctaagttaaggaaagacgaaacggtccctaagtggggtggggacaaacgaacacgtacgccgacgtactaaggtaaaacggcagattcacgtcctctacgaaagtagtaatgtaaacttaacccgaaaaagctaaacgtccgtaccttaaacttctagaccaaacctagtacgaaggaccaacggcccgtaggaaaggaaacggtcggaaacggtaaccttcgaacggtccgttaggttaactttaccgttagtttaactttaagttaaccttcgtaaggtacgttaacggtttaggttttaacgg

SEQ ID NO: 426083 - DNA, 776 bp, Homo sapiens
  misc_feature: GZ8MTXP02IDJSL.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatgacccagtctccatccctcctgtctgctatcgtgtggagacagaatcagcatctacgttggccgggcagtcgagggctattagctaatttattagccttggtaactacaaacgaagaaaacccgaggggaactacggttttaccaaaggtccttacccgtaggtaacttccgttaagtcggtccgttacgtacccccttacccgtaaaccggttttaaccacccgtttaccccgggtaacgggggtttcccccaacgtttcccggtttccggggtttaccacgggggtccggaaccgtagggtaaccgtaaacgtttcggacgggggtaaccctaagggtagtttaccaacccttccgtttaaacaaccttaacggtcaaacggcccgtaccgtccgtacgtacgacgtaccgtacggtaacgtacgttacgttaccgtaaccttaaccttaactttaacgttaacgttaacttaaacgttaaaacgtttaaacgtttaacctttaccctttacccgttaccgtttaccggttaccgggtaccggggtaacgggtaaccggtaacgggtaacggtaacgtaaacgtaaaccgtaaacggtaacggtacggtacggtacg

SEQ ID NO: 426084 - DNA, 575 bp, Homo sapiens
  misc_feature: GZ8MTXP02FSQBG.25.4.A04.1.454.CMB.2.raw
  modified_base (339)..(339): a, c, t, g, unknown or other
  modified_base (359)..(359): a, c, t, g, unknown or other
  modified_base (381)..(381): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggcgagtcgaggcattagctaattattagcctggtatacaaacaagaaaccgagggacgagttccaagctcctgtactctatgctcgcctcacgttacacctcgacgggtccattctcggttcnggcgcagtgaatcgaggganagtagtccactctactacttanccaagcacgcctgaccacgcctaggaagtagttagtacgtacctaaatttacttagtacgtaaactaaaagttactaaacttaccctacgttacccctacgttaccgttaaccggtttcggggaaccggtacggggaaaccgtaaaggggttaggaacgtaaacgttaccgaaaaacggtacgttcggtaccgg

SEQ ID NO: 426085 - DNA, 630 bp, Homo sapiens
  misc_feature: GZ8MTXP02IT4MD.25.4.A04.1.454.CMB.2.raw
  modified_base (273)..(273): a, c, t, g, unknown or other
  modified_base (297)..(297): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggacagccaggccggtccctgacactctcctgcacagcttccggactcacctttggtnagcatgctatcgaccgtgggtccnccaggctccgaggggaggtctaggagtggctttgggttcagttagaagcgaaagcctagtgggtgggacaacacaagtcgccgcgttctaaggtaaaacggccaaggtacttccgaacgtccctacgtacaaaggagtagtagtaaacttaacccgaaaaagtccaaacgtccgtaccttaacgttcctacggactaccgtagtacggaacgccgaacgtcccgtaggaaaggaacggacggaacgggtactacgaacggtcccgttaagttactttaccgtagtttacctttattaaccgtcgtagtagtagttagtttagtttaatttaac

SEQ ID NO: 426086 - DNA, 533 bp, Homo sapiens
  misc_feature: GZ8MTXP02I00C9.25.4.A04.1.454.CMB.2.raw
  modified_base (277)..(277): a, c, t, g, unknown or other
  modified_base (300)..(300): a, c, t, g, unknown or other
  modified_base (446)..(446): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttgggtacagccaggccggtccctgacactctcctgcacagcttccggactcacctttggngagcatgctatgacctgggtccnccaggctccgaggggaaggtctggagtggcttggggttcattagaagcgaagcctagtgggtggggcaaacacataccgccggtcgtctagtaaaaggcaagattcagcctctacaagagatagattaccaaaagcaatcgcctanctgcacatcgagcagcctagagaagcggaggactcgaacggccgtagtacttacgtgtttcttattactctagagtagtagtttagg

SEQ ID NO: 426087 - DNA, 693 bp, Homo sapiens
  misc_feature: GZ8MTXP02GB740.25.4.A04.1.454.CMB.2.raw
  modified_base (193)..(193): a, c, t, g, unknown or other
  modified_base (218)..(218): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttganacagaatcagcatcacttgccgggnagtcagggcagttagctaattattagcctggtatacaaacagaaaccgagggaagagttccaagctcctgactctatcgctcgtcctacctacgttaccaccgtaccgacggggtcccagtccgtcggttacacggtcgacgtagttacgaacttacgttcggggaacctaggtacgtttaccctaccgttaccgtactaaaccgttaacgtcccaacggtaccgttaacgaccccgttcggaccttaaacggcccgtaagggtaaaccgtaggttacggtttacgaaccgttaaaacgtttactttaacgttaacgttaaacctaaaaggtttaattaaaacgttacctttaccggtccccttaccgttaaccgttaccgggttttaccggggaaccgggaccggggtaaaccgtaaggggttaacggacggtaaacttaaccgaaaaccggttaaaccgttcggttaaaccgg

SEQ ID NO: 426088 - DNA, 591 bp, Homo sapiens
  misc_feature: GZ8MTXP02HRY09.25.4.A04.1.454.CMB.2.raw
  modified_base (531)..(531): a, c, t, g, unknown or other
  modified_base (568)..(568): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactgggtggagtcgtggggggaggcttgggtacagccaggccggtccctgacactctcctgcacagcttccggactcacctttggtgagcatgctatgacctgggtccgccaggctccgaggggaacgggtcgtggacggtggtccgtttggggttacagtttaaggaagtccggaaagtcctagtggggtcgggggacaaacgactaaagtaccgccggtcgttacctaaggtaaaacgggcaaggtaatttcccgaagtccctccgttacgaaaggaggattagaactttaccaaaaagcaactcgacctatcctgcacatgagcaagcctagagagngaggactcagcctgttacttacttcgttcttattctntagatagtagttcggttatttag

SEQ ID NO: 426089 - DNA, 526 bp, Homo sapiens
  misc_feature: GZ8MTXP02IYI4L.25.4.A04.1.454.CMB.2.raw
  modified_base (361)..(361): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtcctgacactctcctgcacagccttccggactctaccttggtgagcatgctatgaccgtggtccgcaggctccgaggggaaggtcgtggagtggcgttgggttcagttagaagcgaagcctagtggnggggacaacgacagtcgcgcgtctgtaaaaggcagattcgagcctctacaagtagactagattaccaaaagcaatcgcctatctcgcacatgaagcagcctagagagacgagactcacgtccgtgtacttactgttaacttacttacgtctgatacgtagtttag

SEQ ID NO: 426090 - DNA, 697 bp, Homo sapiens
  misc_feature: GZ8MTXP02JBB7H.25.4.A04.1.454.CMB.2.raw
  modified_base (193)..(193): a, c, t, g, unknown or other
  modified_base (226)..(226): a, c, t, g, unknown or other
  modified_base (245)..(245): a, c, t, g, unknown or other
  modified_base (277)..(277): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaggtgtccaatgtgaggtncaacgtggtggagtcgtgggggagcttggtacngccgaggccgtccctgacnctctcctgcacagcttcggactctactttggngagcatgctagtcgaccgtgggtcccgcgacggcctccggaggggtacggtcgtgggaggtggtcgttgggtacagttagagtcgaaccgtccgtagtcggggtacgggacaaccgacaacgtccggccggtacgttaccgtaaagggtaaaacgcgtagtaacgttacgaccgtacccttaccgtaacgaaaggtagtacgtaacgtaaaccgttaaccaaaaaacggtcctaaacggttaccccgtacccttaaatttcccgtacggaacttaaaccgtagtacggggaaacccgacgtaacggtacgtaagggaaacggaacgggtacggaccgtacgtacggtaccgttacgttacgttactttacggtttatttaaccgtttatacgttagtaggtacggttagtttacgtttag

SEQ ID NO: 426091 - DNA, 534 bp, Homo sapiens
  misc_feature: GZ8MTXP02HDRTK.25.4.A04.1.454.CMB.2.raw
  modified_base (280)..(280): a, c, t, g, unknown or other
  modified_base (505)..(505): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggaggcttggtacagccagggcccggtccctgacactctcctgcacagcttccggactcacctttggngagcatgctatgacctgggtcccgccaggcctccgaggggaaggtctggagtggcttgggttcattagaagtcgaagcccctagtggtggggacaacacaatcgccgcgtctagtaaaagcagattcagcctctacgaagagatgaattaccaaaagcatcgcctatctgcacatcgagcagcctgaagaagcgaacggactcgacgccgtagtactacttgttnttaattactctagagtagtagttgtttaa

SEQ ID NO: 426092 - DNA, 621 bp, Homo sapiens
  misc_feature: GZ8MTXP02JPDDP.25.4.A04.1.454.CMB.2.raw
  modified_base (305)..(305): a, c, t, g, unknown or other
  modified_base (329)..(329): a, c, t, g, unknown or other
  modified_base (368)..(368): a, c, t, g, unknown or other
  modified_base (377)..(377): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggaggtcgtgggggaggcgttggtacagccaggccggtcctgacactctcctgcacagcttccggactctaccttggtcgagctatgctagtcgaccgtgggtcccnccgaggcctccggaggggaggtcnggagtggcgtttgggtcagttagaagcgaagctagtggnggacaacanaactacgccgcgtcaggtaaagcagattcagtccctatacgaagagtatagtaacttaaccgaaaagctactccgacttagttccacgtccaacgtagtcgacgcacggtccaggaacggaacgacggaacgggtacctacggacggtacccgttagttaacgtttaccgttcgtttactttaacgttaacgttacgtagggtaacggttaaggtttacggtttaacggtttaacttttaaacg

SEQ ID NO: 426093 - DNA, 650 bp, Homo sapiens
  misc_feature: GZ8MTXP02GCEKS.25.4.A04.1.454.CMB.2.raw
  modified_base (283)..(283): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgctgttttaaaaggtgtccaatgtgaggtgcaacgtggtggagtcgtgggggagcttggtacagccagggccgtccctgaccactctcctgcacagtccttcccggactctaccgtttggngagcatgacctatggacctggggtcccgccgaggcctccggaggggaacggtcgtgggagtggtcgtttgggttacagttagaagccgaagtccgtagtgggtaggggaccaaacgacgtaacgtccggcccggtacgttaccgtaaaggttaaaacgggctaaacgtacttcgaacgtccctacgtacgaaagaagagtacgtaacttaacccaaaagtcaagtccacttactctcgacactacgagacgacgacgaccgtagaggaacggacggacggtacgtacgacgtacgttacgttacgtttacgttacgtttaacgtttactttaacgttacgtagtacggttaggttacggttttaagg

SEQ ID NO: 426094 - DNA, 544 bp, Homo sapiens
  misc_feature: GZ8MTXP02GOMUQ.25.4.A04.1.454.CMB.2.raw
  modified_base (306)..(306): a, c, t, g, unknown or other
  modified_base (434)..(434): a, c, t, g, unknown or other
  modified_base (527)..(527): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggaggcttgggtacagccagggcccggtccctgacactctcctgcacagcttccggactcaccttggtgagcatgctatcgacctgggtccnccgaggcctccgaggggaaggtcgtggagtggtcgttggggttcaagttagaagcgaacgccgtagtgggtggggacaacacagtaccgccgcgtctagtaaaaggcaagattcagcctctacaaganatagtacttaccaaaagcatcgctatctgcacatgagcagcctagagaacgcgaggactcgagtaccgtagtacttactgttcttacttactntagagtagttagtttag

SEQ ID NO: 426095 - DNA, 616 bp, Homo sapiens
  misc_feature: GZ8MTXP02IGGME.25.4.A04.1.454.CMB.2.raw
  modified_base (305)..(305): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttggtacagccaggcccggtccctgacactctcctgcacagccttccggactcacctttggtgagcatgctatgacctgggtcccncaggctccgaggggaaggtctgggagtgggcgtttggggtcagttaggaagcgaacgcctagtgggtggggacaaacgacagtaccgccgcgttactaggtaaaaggcaagacttcacgccctactacaaagagatagaacttaccgaaaagcaagtccgacctatcctgaccacatagagacgacgaccgtagagaacggacggacggacgtacgtaacggtcccggttacggttaacgtttaactttacgtttaacgttttaactttactttaccgttaggtacggttaacggtttaacggttttaagg

SEQ ID NO: 426096 - DNA, 523 bp, Homo sapiens
  misc_feature: GZ8MTXP02FLSQZ.25.4.A04.1.454.CMB.2.raw
  modified_base (345)..(345): a, c, t, g, unknown or other
  modified_base (388)..(388): a, c, t, g, unknown or other
  modified_base (413)..(413): a, c, t, g, unknown or other
  modified_base (418)..(418): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggcgagtcgagggcattagctaattattagcctggtatacaacaagaaaccgagggagagttcctaagctacctgatctatcgctgccctctacgttacacctcgacggggtcccatcgtcggttcgngcgcgagtgaatcgtgggactagtagttacactctctacttancagcacgcctgcacgcctagaagtntggtnactaattatactagtaacaaaatataatactcgtcccttctctacgttcggacgggtacggaaccgtaaggtaggaacgacgtaacgaaacgtaacgtggtacgg

SEQ ID NO: 426097 - DNA, 644 bp, Homo sapiens
  misc_feature: GZ8MTXP02I8DKZ.25.4.A04.1.454.CMB.2.raw
  modified_base (253)..(253): a, c, t, g, unknown or other
  modified_base (513)..(513): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggcccggtccctgacactctcctgcacngcttccggactctaccttggtgagcatgctatgaccgtgggtcccgccgaggctccgaggggacggtcgtggagtggtcgtttggggttcagttagaagcggaagtccgtagtggggtcggggacaaaccgtacaacgtacgcccggtacgttacgtaaggtaaaacggctaaggtactttccgaacgtccctacgtacgaaaggaggtaattagtaacttaacccgaaaagcctaactccgaccttactctacgcaacntagacgaccgagccgtagaggaacgacggacggaacctcgacggtccgttagttaactttacgttcgtttactttaactttaaccgtcgttaggtaggtaaggtttacggttacggttttaattttaaacg

SEQ ID NO: 426098 - DNA, 571 bp, Homo sapiens
  misc_feature: GZ8MTXP02IHH2M.25.4.A04.1.454.CMB.2.raw
  modified_base (219)..(219): a, c, t, g, unknown or other
  modified_base (349)..(349): a, c, t, g, unknown or other
  modified_base (354)..(354): a, c, t, g, unknown or other
  modified_base (369)..(369): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtccagatgacccagtctccatccctcctgtctgctatctgttggagacagaatcagcatcacttggccggngagtcgagggcattagactaattattagctaggtatacaaacaagaaaaccgagggagtacgttacctaagctacctgatctatcgtctcgtacctcctacgtacacctcgacgggtccagtcgtcgtcnggcgnagtagaatgtagganagtagtcactctacactatcacgcacgtccctagaccgacgtacctagtaaagtattagggttactacttaaactttaactttaacgtaagttaaactaaaattataaactaccgtaccgtcccttacttaccgtaccggtttcgggacgggtaacggaaccgtaagggtacgaacgtactaacgaaacgtacgtggtacgg

SEQ ID NO: 426099 - DNA, 622 bp, Homo sapiens
  misc_feature: GZ8MTXP02IED34.25.4.A04.1.454.CMB.2.raw
  modified_base (280)..(280): a, c, t, g, unknown or other
  modified_base (302)..(302): a, c, t, g, unknown or other
  modified_base (500)..(500): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagcttgggtacagccaggcccggtcctgacactctcctgcacagccttccggactcacctttggnagcatgctatgacctggtcccncaggctccgagggaaggtctggagtggtcttggggttcagttaagaagcgaaagcccctaagtcgggtggggacaaacgaacaaattaccgcccgtcgttccgtaaggtaaaaaacgggcaaagtacttccgaagcctactacaaagaagataggattaacccaaaaagcaataccgtccctaatccttgacccaaanatagacgacgacgacgtagagaacgacggaacggacgtacgacgtacgttacgttacgtttacgtttacgtttactttaacgtttacgttacgttacgtagtaggtttaggtttagtttaag

SEQ ID NO: 426100 - DNA, 534 bp, Homo sapiens
  misc_feature: GZ8MTXP02GILIT.25.4.A04.1.454.CMB.2.raw
  modified_base (193)..(193): a, c, t, g, unknown or other
  modified_base (354)..(354): a, c, t, g, unknown or other
  modified_base (393)..(393): a, c, t, g, unknown or other
  modified_base (407)..(407): a, c, t, g, unknown or other
  modified_base (423)..(423): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgaccagtctccatcctcctgtctgcatctgttgganacagaatcagcatcacgttcggccgggcgagtcgagggctattagactaattattacgcttaggtatacaaacaagaaaccgagggagtacgttacctaaagtctacctagtatctatgactcgcctacacgttacacctcgacggtcctatcgtcgttcngcgacagtagagtgtaggacagtactcactctacactancagcacgctcgacncgacagtagattgtanaaccttattattactagtaactaaaatataatactacctcccttactacgttacgttcgggacgtaggaaccgtaaggtacgaacgtaactacgaaaacgtcgtaggtacg

SEQ ID NO: 426101 - DNA, 508 bp, Homo sapiens
  misc_feature: GZ8MTXP02JZXB0.25.4.A04.1.454.CMB.2.raw
  modified_base (374)..(374): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtccctgacactctcctgcacagccttccggactcacctttggtgagcatgctatgacctggtccgccaggctccgagggaaggtctggagtggcttgggtcattagagcgaagcctatggtggggcaacgcatacgccgngtctgtaaaaggcagattcagcctctcaagagatgattaccaaaagcaatcgcctatctgcacatgagcagcctgacgagcgaggactcagccgtgtacttactgttaattattactctagagtagtagtttag

SEQ ID NO: 426102 - DNA, 504 bp, Homo sapiens
  misc_feature: GZ8MTXP02FI1G4.25.4.A04.1.454.CMB.2.raw
  modified_base (269)..(269): a, c, t, g, unknown or other
  modified_base (331)..(331): a, c, t, g, unknown or other
  modified_base (370)..(370): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattattagcctggtatcaacagaaaccaggganagttcctaaagctcctgatctatgctgcctcacgttacacctcgacgggtccatctcgttcngcggcagtgaatcgtgggacagagttacactctcactancagcagcctgcagcctagaagatgttagctaattattactgtacaaaagtataaatactcgacccctctacctacgtttacgggacgacgggtaccgaagggtcggtaagactaccgaaaacgaccgtgtacgg

SEQ ID NO: 426103 - DNA, 597 bp, Homo sapiens
  misc_feature: GZ8MTXP02I9DCT.25.4.A04.1.454.CMB.2.raw
  modified_base (495)..(495): a, c, t, g, unknown or other
  modified_base (500)..(500): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggagcttggtacagccaggccggtccctgacactctcctgcacagccttccggactcacctttggcgagcatgctatggacctggtccgccaggctccgaggggaaggtctgggagtgggcgttgggttcaagttaggaagtcggaaacgcccgtaagttggggtaggggaccaaacgaacgaagtaccggcccgacgttaccgtaaggtaaaaacgggccaaaggtaattcgaagccctactacaaagagatagaacttaccaaaagcatccgacctatcgtnccaanatagagcgacgcgagacgaagcgacggacacgacgtacgtacgttacttacgttacgtttaacttacgttactacgtaggtacgtaggttagttacg

SEQ ID NO: 426104 - DNA, 675 bp, Homo sapiens
  misc_feature: GZ8MTXP02JGLDB.25.4.A04.1.454.CMB.2.raw
  modified_base (278)..(278): a, c, t, g, unknown or other
  modified_base (302)..(302): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttgggacagccaggccggtccctgacactctcctgcacagcttccggactcacctttggnagcatgctagtcgaccgtcggccncgaggcctacggaggggtacggtcgtgggagtggtcgttgggtactaagttaggaagcgaacgtccgtaggtcgggacgggacaaacgaacacgtaccgccgtacgtacgtaaggtaaaacgcaagtactcgacgcctactacgaagagtatacgtaactaacgaaaagctaacgtccgtaccttacgtcgtacgacaacgagtacgacgacgtacgaccgtaaggaaacggaaacggaccggtaaacggtacccgtaaccggaacggttaccggtttaacgtttaaccgtttaacgtttacgttttaaccgttttaaacgtttaaccgttacggttaaggttaaacggtttaacggtttaacggttttaaag

SEQ ID NO: 426105 - DNA, 518 bp, Homo sapiens
  misc_feature: GZ8MTXP02H8LTF.25.4.A04.1.454.CMB.2.raw
  modified_base (278)..(278): a, c, t, g, unknown or other
  modified_base (381)..(381): a, c, t, g, unknown or other
  modified_base (444)..(444): a, c, t, g, unknown or other
  modified_base (450)..(451): a, c, t, g, unknown or other
  modified_base (455)..(455): a, c, t, g, unknown or other
  modified_base (457)..(457): a, c, t, g, unknown or other
  modified_base (471)..(471): a, c, t, g, unknown or other
  modified_base (473)..(473): a, c, t, g, unknown or other
  modified_base (487)..(487): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggagcttggtacagccagggccgtccctgacactctcctgcacagccttccggactcaccttggngagcatgctatcgacctgggtccgccaggctccgaggggaaggtcgtggagtggcgttggtcagttagaagcaagctagtgggtgggacaacgacatacgccncgtctagaaaaggcagattcagcctcacaagagatgaactaccaaagcaatccgcctagttcngaccannagancngcagagagcgagcncncgcgtatacttgtnttaacttactactctagtacgtagttagtag

SEQ ID NO: 426106 - DNA, 692 bp, Homo sapiens
  misc_feature: GZ8MTXP02GK5Z7.25.4.A04.1.454.CMB.2.raw
  modified_base (284)..(284): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttggcttaactgttcttttccttgttgcttagttttaaaggtgtccaatgtgaggtgcaactggtggagtcgtgggggagcttggtacagccaggcccggtccctgaccactctcctgcacagccttccggactctaccgtttggngagcatgctatcgaccgtggggtcctcgacggcctaccgaggggtaacggtcgtgggagtgggtcgtttggggttacaagttagaaggtcgaaacgcctagtggggtacggggacaaacacacgtccgccgtcgtacgtagtaaaaggcaagtattcacgtccctacactaaagagtagttagtaacttaacccaaaaggccaagtacccgtaccttacttactaggacctaacaagttagaagaccgaacggtcccgtaagggaaaggaaacggtaaccgggaaacgggtaccgttaccggaaacggttcccggtttaagtttaaaccttttaacgtttacgttttaaccttttaaagttttacttaccgttaggtaaacggttaagggttttaacggtttttaagg

SEQ ID NO: 426107 - DNA, 750 bp, Homo sapiens
  misc_feature: GZ8MTXP02IOPYU.25.4.A04.1.454.CMB.2.raw
  modified_base (285)..(285): a, c, t, g, unknown or other
  modified_base (312)..(312): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagttgggcttaactgttcttttccttgttgctgttttaaaaggtgtccaatgtgaggtgcaactggtggagtcgtgggggaggcttggtacagccagggcccggtcctgaccactctcctgcacacgccttcccggactctaccgtttggngagcatgctatcgacccgtgggtcccnccgagggcctccggaaggggaacggggttcgtggggaggttcgggtcgtttggggttactaagtttaggaaacggcggaaacgtcccgttaaggtggggtacggggaccaaaccgacgtaacgtaccggcccgtacggttactaagggtaaaaacgggctaaaggtacttacgacggtccctacgtacgaaaagtagaattaggtaacttaaccgaaaaacgtctaaacgttcccgaccttacttccgttacgaccaaaccagtaggacgaccgtaaacggcccgtaagggaacggaaacgggtacggaaacggggtccttacggtaaccggtacccggtttacggtttaaaacctttaccgtttttggtttaacccgttttaaattttaacccgttacggttaggtaaacgggttacggtttaaaggtttttaacgg

SEQ ID NO: 426108 - DNA, 632 bp, Homo sapiens
  misc_feature: GZ8MTXP02G87F4.25.4.A04.1.454.CMB.2.raw
  modified_base (195)..(195): a, c, t, g, unknown or other
  modified_base (378)..(378): a, c, t, g, unknown or other
  modified_base (417)..(417): a, c, t, g, unknown or other
tcagactgtacagtcacgaccggtgctcgatttagagtagtgatcgagggggcagaagtctctctcagtcaggacacagcatggacatgagggtccctgctcagctcctgggactcctgctgctctggctcccagataccagatgtgacgtccagatcgacccagtctccatccctcctgtctgcatctgtgganacagaatcagcatcacttggccgggcgagtcgagggctagttagactaatttattacgacctggtaactacaaacgaagaaaaccgagggataacgttctaagccttacctagtactctatcggtctacgtccctcctaacggttaccacccgtcgtaccggggtaccattccggtcgttacncggtccgacaggtagtacgtcgtagggaacagtcgtacnctctacaactctacgacgacgacgtcccgcgaccgtagtacgtagtaagtagttagtacgtaacttaaacttaagttaacgtaagttaaaactaaaagttacgttaaaccgttacctacccgttacccttaccttaccggttaccggttacgggacgggtaacggaacggtaacggtacgaaacgtaacgtaaaccgtaaacggtacggtcgacg

SEQ ID NO: 426109 - DNA, 541 bp, Homo sapiens
  misc_feature: GZ8MTXP02GJ8DY.25.4.A04.1.454.CMB.2.raw
  modified_base (194)..(194): a, c, t, g, unknown or other
  modified_base (219)..(219): a, c, t, g, unknown or other
  modified_base (273)..(273): a, c, t, g, unknown or other
  modified_base (339)..(339): a, c, t, g, unknown or other
  modified_base (415)..(415): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggnagtcagggcattagctaattattagcctggtatacaaacaagaaaccgaggganacgttacctaagctcctgatctatgctcgcctcacgttacacctcgacgggtcccatctcggttcnggcgcagtgaatcgtagggactaggtacttacacttctacactatcgagccagccctggaccagcctaggtaagtnttgttagactaaacgtttattactagtaactaaaatataacttactaccgtccctacgttacctacggttacggggacggtacggtaaccgaagggtcgaacgtactacgaaacgtacgtggtacg

SEQ ID NO: 426110 - DNA, 710 bp, Homo sapiens
  misc_feature: GZ8MTXP02IDZNY.25.4.A04.1.454.CMB.2.raw
  modified_base (340)..(340): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtccagatgacccagtctccatccctcctgtctgctatctgttggagacagaatcagcatcacgttggccgggcgaggtcgagggctaagttagctaattattagccgtaggtaatacaaacaacgaaaccgagggatacgtttaccaagtctacctgactcttatcgtctcgtaccctaccgtacgttaccnccgtaccgtaccggggtcccctagttccgttccgggttacgacggccgggtacgtaggttacgtaacgttcggtagggaccgtaaggtacgttacctacctcttaaccacgtttaacacgacgaccgtacgtccgtcgacgtacgtacgtaggtagtagttagttacgtaactttaacgtttaacgttacgttaaacgttaaaactaaaacgtttaacttaaacccgttaccgttacccgttaccccgttacgttacccggttaaccgggtttaccgggggaaccggggtaaacgggtaaaccgggtaaggggtaacggtaaaacggtaaccggtaaaaccggtaaaaccggttacggttacgggtacgg

SEQ ID NO: 426111 - DNA, 715 bp, Homo sapiens
  misc_feature: GZ8MTXP02JC5K5.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctggttggagacagaatcagcatcacgttcggccgggacgagtcgagggtcaagttagctaatttagttacgcctaggtaataccaaacgaacgaaaaccgaggggtaatacgtttaaccgtaaacgccgttacctagtaacttcgtaagtcggtccttcgccccttaccgtaacgttaccaccccgtaccggtacggggtacccctaagtttccgttacgggttacaccgggtccggtactaacggttagaaacgtttccgggtaagggaacgtaaacggttacggtttaccacctttacccgtaactaaccctttaacgtaccgacgtacgaccgtccgtacgaccgtacgtacgtaaggtacgtagttacgtaactacgttaaacttacgttaacgtaaagttaaaactaaagttaactaacgttaccgtaccctacccttacgttaccgtacgggttaccgggaacggtaacggtaaacgtaaggacggtaaacgtaacgtaaacgtaacggtacgtacggtacgg

SEQ ID NO: 426112 - DNA, 730 bp, Homo sapiens
  misc_feature: GZ8MTXP02GTSQZ.25.4.A04.1.454.CMB.2.raw
  modified_base (312)..(312): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaggtgtccaatgtgaggtgcaacgtggtggagtcgtgggggagcttggtacagccgagggcccggtccctgacactctcctgcacagtccttccggactctacctttggtgagcatgctatcgaccgtcgggtcccnccgagggcctaccggaaggggtaacgggtcgtaggggtaggttcgggtacggtttggggtttactaagtttaacggaaacggtccggaaaaccggtcccgttaaggtcggggtacggggaccaaaccgaacgtacgtaccggcccggtacgttaccgtaaggtaaaaggccaagtacttccgacgtccctactacgaaagtagagtagaacttaacccgaaaaagtcctaaacgtccgtacccttaagttccctaggacccaaacgtaagtacgacgtacgtacgtaccggtaaggaaacggaacggtacggaacggtacctacggtacggttaccggttacgtttaacgtttacgtttacgttttaacgtttaacgtttacgttacgtaggtaacggttaacggtttaaggtttacg

SEQ ID NO: 426113 - DNA, 640 bp, Homo sapiens
  misc_feature: GZ8MTXP02J2SQN.25.4.A04.1.454.CMB.2.raw
  modified_base (258)..(258): a, c, t, g, unknown or other
  modified_base (279)..(279): a, c, t, g, unknown or other
  modified_base (308)..(308): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaacgtggtggagtcgtgggggaggcttggtacagccaggcccggtcctgacactctctgcacngccttccggactcactttggngagcatgcttatcggaccgtgggtccccnccgaggcctccggaaggggaacggtcgtgggaggtgggtcgtttggggtacaagtttaaggaaggtacgaacgtccttaggtggggtacggggacaaacgacagtccgcccggtcgtacgtaaggtaaaacggccaaggactttacgacgtccctactacgaagagtatacgtaacttaacccgaaaagctaaacgtccgtacctatctacgaccaactagtagacgacgacgaccgtagaacgaagacggacggacgtacgacgtacgtacgttacgttacgttacgtttaacgtttacttactacgtaggtacgtacggttagtttaagg

SEQ ID NO: 426114 - DNA, 571 bp, Homo sapiens
  misc_feature: GZ8MTXP02GFOIW.25.4.A04.1.454.CMB.2.raw
  modified_base (220)..(220): a, c, t, g, unknown or other
  modified_base (272)..(272): a, c, t, g, unknown or other
  modified_base (330)..(330): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggnagtcagggcattagctaattattagcctggtatacaacaagaaaccaggganagttcaagctcctgatctatgctgcctcacgttacacctcgagggtccatctcgttcngtcgcagtagatcgtagggacagtagttcactctacactatcagcacgcctgacacgccgtagaaagtattacggttagaccttaaactttaactttaacttacgttaaacaaaaaagtttattaaaacttaccttaccgaccccctttactacccgttaacggttttaccgggacggggtaacgggaaccgtaaaggggttacgaacgaacgttaacgaaaacggtaaacgtggtaccgg

SEQ ID NO: 426115 - DNA, 704 bp, Homo sapiens
  misc_feature: GZ8MTXP02HQJIR.25.4.A04.1.454.CMB.2.raw
  modified_base (285)..(285): a, c, t, g, unknown or other
  modified_base (313)..(313): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttgggacagccgaggcccgtccctgacactctcctgcacagtccttccggactctaccgtttggngagcatgctagtcgaccgtcgggtcccnccgagggcctccggaaggggtaagggtcgtggggagttgggtcgtttgggttacaagtttaaggaaggcgtaacgccgttaagtggggtacggggacaaaccgaacagtaccggccgtacgtaccgtaaggtaaaaacggctaaagacttcgaacgtcccttacaacgaaagaagtagttaagtaaacctttaaccgaaaaacgtccaaacgtttcccgtaccctttaacttccgttacgacccaagtagtgaacgacgtacgccgtaagggaagaaacggcggtaaacgggtaccttaccggaacggttcccgtttagttaacttttaacgttcgttttaactttaacgtttaaccgttcgtagtaacggttaggtttaagttttaaagg

SEQ ID NO: 426116 - DNA, 597 bp, Homo sapiens
  misc_feature: GZ8MTXP02F5ZXE.25.4.A04.1.454.CMB.2.raw
  modified_base (278)..(278): a, c, t, g, unknown or other
  modified_base (301)..(301): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagcttccggactctacgtttggngagcatgctatgaccgtgggccncaggcctccgagggaggtctggagtggtcgttggtacagttagagcgaagcccctaagtggtaggggacaaacgacaagtaccgccgtacggttacctaggtaaaacggctaagtattacagtcccgtactacgaaagagatgacttaaccgaaaagtcattaccgaccttattcagcaacgtatagacgcaagccgagaagacgcgaaggacctcgacgtccgttagttaactttacgtgtttttaccttaagtttacctacggtacggtaagttaggtagtttacggttttaaa

SEQ ID NO: 426117 - DNA, 584 bp, Homo sapiens
  misc_feature: GZ8MTXP02G9AP4.25.4.A04.1.454.CMB.2.raw
  modified_base (193)..(193): a, c, t, g, unknown or other
  modified_base (218)..(218): a, c, t, g, unknown or other
  modified_base (270)..(270): a, c, t, g, unknown or other
  modified_base (332)..(332): a, c, t, g, unknown or other
  modified_base (337)..(337): a, c, t, g, unknown or other
  modified_base (373)..(373): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttgccgggngagtcgagggcattagcaattattagcctggtatacaacagaaaccaggganagttacctaagctcctgatctatgctgcctccacgtacactcgacgggtccatctcggttcnggcgnagtgaatcgtagggacagtgttcactctacacttanacacgacacgccgtcgacgacgacgtagtaagtagttacgtactaacttaactttacttaacgtacgtaaactaaaagttaacttaaacttaccgtaccgtaccccttacgttaccgttaccggtttacggggaaccggggtaacgggtaaaccggtaacgggtaacggtaaacgtaacgtaaaccgtaaaacggtacggttacggtacgg

SEQ ID NO: 426118 - DNA, 642 bp, Homo sapiens
  misc_feature: GZ8MTXP02JTT7S.25.4.A04.1.454.CMB.2.raw
  modified_base (275)..(275): a, c, t, g, unknown or other
  modified_base (346)..(346): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctccctgtctgcatctgttggagacagaatcagcatcacgttggccgggcgagtcgagggcattagcaattattagcctggtatacaacagaaaccaggganagttctaagctcctgatctatgctcgcctaccacgttacaccgtcgacggggtcccacttcgtacggttcncggcggcagtgaatcgtacgggacagtagttccacgtcctcaatactcacgcacgccctgaccacgtccgtaggtaaagtgttacggtttagaacctttaaaaccgtttaatttaaccgttagtttaaacccggtaaaaagtttaactaaaacggtttaccgttacccgttacccccttacttacccgttaaaccgggttttcccggggaaccgggggtaaccggggttaacccggaaggggttacggggaacgtaaacgttaaccggaaaaccgtaccgggttaggttaaccggg

SEQ ID NO: 426119 - DNA, 523 bp, Homo sapiens
  misc_feature: GZ8MTXP02JGYU2.25.4.A04.1.454.CMB.2.raw
  modified_base (278)..(278): a, c, t, g, unknown or other
  modified_base (376)..(376): a, c, t, g, unknown or other
  modified_base (448)..(448): a, c, t, g, unknown or other
  modified_base (458)..(458): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagcttccggactcacctttggngagcatgctatgacctgggtccgccaggctccgaggggaaggtcgtggagtgggcttggggttcagttagaagcgaagcctagtggtggggcaacganagtacgccgcgtctagtaaaaggcagtattcagcctctacaagagatgacttaccaaaagcaatcgctatcngcacgatgancagcctagagagcgaggctcgagccgtgtacttactgttcttattactctgagtacgtagtttag

SEQ ID NO: 426120 - DNA, 602 bp, Homo sapiens
  misc_feature: GZ8MTXP02IPM8S.25.4.A04.1.454.CMB.2.raw
  modified_base (310)..(310): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaacgtggtggagtcgtggggggagcttggtacagccaggccggtccctgacactctcctgcacagccttccggactctaccttggtgagcatgcttagtcgaccgtggggtcccnccgagggcctccgaggggaaggtctgggaggtggtcgtttgggttcagttagaagcgaagtcctagtgggtcggggacaaacgacactacgccgcgttacgtaggtaaaaggcaagtattcgacgtcctctacaaagagtatgtaacttaaccgaaaagctaaagtccgtacctaacttctcgacacaagtcgagcgaacgcctaggaacgaacggacgaggacctcgaacggtccgttagttactttacgttgtttaacttacttactcgttagagtagttaggttttaag

SEQ ID NO: 426121 - DNA, 582 bp, Homo sapiens
  misc_feature: GZ8MTXP02GU7DK.25.4.A04.1.454.CMB.2.raw
  modified_base (277)..(277): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgacactctcctgcacagcttccggactcacctttggngagcatgctagtcgaccgtgggtcccgccgaggctccgaggggaaggtctggagtggtcgttgggtcagttagagcgaagccctagtgggtggggacaacacaactccgccgcgtcgtagtaaaagcagacttacagtccctctacgaagagtatacgtaacttaacccgaaaagcaacgtaccgacccttaatctgacacgatgacgcacgcctagaagaacgcgacggaactcgacggtccgtagttacgttacttgtttacttaacgttacctcgtagagtacggttagttaggttttaaac

SEQ ID NO: 426122 - DNA, 604 bp, Homo sapiens
  misc_feature: GZ8MTXP02F34I0.25.4.A04.1.454.CMB.2.raw
  modified_base (275)..(275): a, c, t, g, unknown or other
  modified_base (302)..(302): a, c, t, g, unknown or other
  modified_base (498)..(498): a, c, t, g, unknown or other
  modified_base (503)..(503): a, c, t, g, unknown or other
tcagactgtacagtcacgaccggtgctcgatttagagtagtgatcagggggctgggagaggagccccagccgtgagattcccaggagtctccacttggtgatcagcactgaacacagaccaccaaccatggagtttgggcttaactgtcttttccttgttgcttgttttaaaagtgtccaatgtgagtgcaactggtggagtcgtgggggagcttggtacagccaggccggtcctgaccactctcctgcacagcttccggactctaccgtttggngacgcatgctatcgaccgtgggtaccnccgtaggcctccggaagggtaggtctagggacgtggtcgtttgggttcagtttaaggagcgaagcctagtgggtgggacaacgacaatccggccgacgtcgtaaggtaaaacgcaaggtacttcacgcccttacacgaaagagtattagaccttaacgaaaagtcaatccgtacctagtctcgacacagtagaccncgacncgtaggaagacgcgtaacgactacgacgtccgttattactttacgttacgtttacttataacgttagtaggtagttagttacgtttagtttaactttaacg

SEQ ID NO: 426123 - DNA, 606 bp, Homo sapiens
  misc_feature: GZ8MTXP02J4VV4.25.4.A04.1.454.CMB.2.raw
  modified_base (175)..(175): a, c, t, g, unknown or other
  modified_base (277)..(277): a, c, t, g, unknown or other
  modified_base (300)..(300): a, c, t, g, unknown or other
  modified_base (390)..(390): a, c, t, g, unknown or other
  modified_base (437)..(437): a, c, t, g, unknown or other
  modified_base (450)..(450): a, c, t, g, unknown or other
  modified_base (477)..(477): a, c, t, g, unknown or other
  modified_base (492)..(492): a, c, t, g, unknown or other
  modified_base (494)..(494): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtctttcctgttgctgttttaaaaggngtccaatgtgaggtgcaactggtggagtctggggtaggcttggtacagcctaggccggtccctgacactctcctgcacagcttccggactcaccttgtgagnactgctatgccgtcggtcggccncggctccgacggaaggggtctggaggtggtcgtttgggtttcgtactagtaagacgacgacccgtcgtggtgggaacggacaaacttacncgtaccgccggtccgtacgttaagacgaaagggtcctagtacttccnccgtcctacgaanaaggatctaacgtaacctaaacgaacnctacgtcctatcacncncagacagactacgcgtacggagaacgacggtacgacgtaccgtagtccgtttacgttagttcctttagttaacgtttacttacgttcgttagtacgttaggttaacgtttag

SEQ ID NO: 426124 - DNA, 658 bp, Homo sapiens
  misc_feature: GZ8MTXP02GI6OF.25.4.A04.1.454.CMB.2.raw
  modified_base (548)..(548): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtggggggagtcgttggtacagccaggcccggtccctgacactctcctgcacagtcttccggactctacctttggtgagcattgctagtcgtaccgtgggtccgccaggcctccgaaggggtaaggtctagggacggtgggtcgtttggggttcaagtttaaggaaggtccgaaacgtcccgtaaggtggggtacggggacaaaaccgacgaagttacccggcccgtacggttacctaaagggtaaaaacgggctaaagggtaacttcgaaccggtcctcgtacaaagtacgatggaacttaccgaaaagtctaagtccgactatctgactaacatgaacncgaacgcctaggaacgaacggcgaacggtactacgtaacggtccgttagttacttacttcgtttaacgttaactttaccgttcgtacggagttacggtttaagtttacgg

SEQ ID NO: 426125 - DNA, 621 bp, Homo sapiens
  misc_feature: GZ8MTXP02I0U83.25.4.A04.1.454.CMB.2.raw
  modified_base (494)..(494): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccgaggccggtcctgacactctcctgcacagtccttcccggactctaccgtttggtgagcatgctatcgaccgtcgggccccgcgaggctccgaggggaaggtctgggagtggtcgttgggtcagttagaagcgaacgcctagtcgggtagggacaaacgacagtccgccgtcgtactaaggtaaaacggcaaggtattccgaacgtccctactacgaaagagtatacgtaacttaacccgaaaagcctaacgtccgtacctattcncgacaacagtcgacgcacgtccgagaagaacgacggaggacctacgaacggtccgttagttaactttaccgttgtttaacctttaagttaccttacgtaggtaaggttacggtttaggttttaacgg

SEQ ID NO: 426126 - DNA, 597 bp, Homo sapiens
  misc_feature: GZ8MTXP02HYLM8.25.4.A04.1.454.CMB.2.raw
  modified_base (395)..(395): a, c, t, g, unknown or other
  modified_base (415)..(415): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaacgtggtggagtcgtgggggagcttggtacagccgaggccgtccctgacactctcctgcacagcttccggactcaccttggtgagcatgctatcgacctgggtccgccaggcgtccgaaggggaaggtcgtgggagtgggcgtttgggttcaagttagaagcgaacgcctagtggtggggacaacacatacgccgtcncgtagtaaaggcagattacngacctcacaagagatagactaaccgaaaagcatccgacctattctgcacagtgacggcacgcctaggaacggaacgcgggaagacctacgacggtacccgttagttaacgttttaaccgtttcgtttaaccgtttaactttacgtcgttaaggtaacggtttacggtttaagggttttaagg

SEQ ID NO: 426127 - DNA, 538 bp, Homo sapiens
  misc_feature: GZ8MTXP02F8695.25.4.A04.1.454.CMB.2.raw
  modified_base (513)..(513): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtggggggaggcttggtacagccaggcccggtccctgacactctcctgcacagccttccggactcacctttggtgagcatgctatgacctgggtccgccaggctccgaggggaaggtcgtggagtgggcttggggttcattagaagcgaaagcctagtggtgggcaaacacaatacgccgcgtctagtaaaagcaagattcagcctctcaaagagatagattaccaaaagcaatcgacctatctgcacatgagcagcctagagaaagcgaaggactacgagcctagtacttactgttcttattaacctntagtagtagtacgtagttatttaac

SEQ ID NO: 426128 - DNA, 675 bp, Homo sapiens
  misc_feature: GZ8MTXP02I5DBS.25.4.A04.1.454.CMB.2.raw
  modified_base (291)..(291): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcggtgggggaggtcttggtacagccgaggcccggtcctcgacactctcctgcacacgtccgtccggactctaccgttggtgngcatcgtctacgtacggtaccgtcgggtccgaccgacggccgtcggaacggggaaggggttcggtgggtaggtcggttcggtttcgggttactaagttaggaaaggtacggaaccgtaccgtaggtcgggtacggggaactaaccgacaacgtcgcccggtacgtacgtaggtaaacgcagtatcaacgtcctactacgaaagacgtacgtagtaacttaaccgaaaagctaaccgtactacctataccgtcgacaaccgatacgagtaccgagccgaagacggaacggacggaacgtaccgtacgaacggtccgtttagttaactttacgttacgtttaacttacgtttaccacggttagacggttacggtttacgttttaag

SEQ ID NO: 426129 - DNA, 611 bp, Homo sapiens
  misc_feature: GZ8MTXP02JY0AO.25.4.A04.1.454.CMB.2.raw
  modified_base (279)..(279): a, c, t, g, unknown or other
  modified_base (307)..(307): a, c, t, g, unknown or other
  modified_base (377)..(377): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtggggggaggcttggtacagccgaggccggtccctgacactctcctgcacagtccttccggactctaccgtttggngagcatgctagtgacccgtggggtcccnccgaggcctccgaaggggagggtctgggaggtggcgtttgggtcagttaggaagcgaagcctagtggggnggggacaaacacaagtacgccgcgtactaggaaaagcagtattcacgcctcgtacaagagatagtacttaccaaaagcactcgcctatctgcacatgacgcgacgccgtaggacggaacgcggaacggactaccgagggtacccgttaggttaactttacgttacgttttactttactttaaccgttacgttaggtacggttaggtttaacggtttacggtttaattttaaacg

SEQ ID NO: 426130 - DNA, 652 bp, Homo sapiens
  misc_feature: GZ8MTXP02ISVZR.25.4.A04.1.454.CMB.2.raw
  modified_base (284)..(284): a, c, t, g, unknown or other
  modified_base (555)..(555): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaggtgtcaatgtgaggtgcaactggtggagtcgtgggggagtcttggtacagccgacgggcccgtcctgacactctcctgcacacgtcttccggactctacctttggngagcatgactagtcgaccgtggggtccccgccgacgggtccgtacccggaaggggtaacgggttcgtagggtaggttgggtcgttttggggttactaagttaaggaaacgacggtaacgtccgttagtggggtacggggactaaaccgaacgtacgtaccgccggaccgttacgtaaggaaaacggctaagtacttacacggtccctactacaagtagatagtaacttaacccaaaagtccaatcccgtacttattctgacacagtgaacncgacgccgtaggaagaacggcgacggactcgaggtccgttagttacttacgttgtttaacttacttacgttacgagtacgttaggtttacgtttaag

SEQ ID NO: 426131 - DNA, 667 bp, Homo sapiens
  misc_feature: GZ8MTXP02JNCB9.25.4.A04.1.454.CMB.2.raw
  modified_base (283)..(283): a, c, t, g, unknown or other
  modified_base (446)..(446): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttagttttaaaaggtgtccaatgtgaggtgcaactggtggagtcgtgggggaggcttggtacagccgaggcccggtcctgacactctcctgcacagccttccggactctaccgtttggngagcatgctatcgaccgtgggtcccgccgaggcctccgaggggaaggtcgtgggagtggtcgtttgggtcagttagagcgaagccctaggtggggtagggacaacacaagtaccggccgtagtccgtaaaggtaaaacgggcaagtacttcgacgtcccttanaacgaaggaagtagttacggtaactttaacccgaaaaagtcctaaccgttaccgacccctttaatccgtacggtacctaactagtcgaaagccgaacggtaccgaggaaggaaacggcgggtaacggaacctcgaaccggttccggttaagtttactttaacgtttcgtttacttaacgttcctacgttaggaacggttagtttaggttagtttttaaacc

SEQ ID NO: 426132 - DNA, 576 bp, Homo sapiens
  misc_feature: GZ8MTXP02H93SK.25.4.A04.1.454.CMB.2.raw
  modified_base (193)..(193): a, c, t, g, unknown or other
  modified_base (218)..(218): a, c, t, g, unknown or other
  modified_base (351)..(351): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttgganacagaatcagcatcacttggccggngagtcgagggcattagcaattattagcctggtaatcaaacaagaaaacccgagggaagtacgttacctaaagcctacctgatctatgctcgccctacctacgtacacctcgtacgggtcccagtctcggttcngcgcagtgaatcgtaggacagtagtcactctacactatcagcacgcctgacgacgtcctagaagtatggttacgtactaaactttattaactagttaactaaaattactaaaactacctacgtcccctacttaccgttaaccgtttaccgggaaccggtacgggtaaccgaaaggggttacggaacggtaacttaaccgaaaacggtaaacgtttcggtaaccgg

SEQ ID NO: 426133 - DNA, 529 bp, Homo sapiens
  misc_feature: GZ8MTXP02JCK18.25.4.A04.1.454.CMB.2.raw
  modified_base (194)..(194): a, c, t, g, unknown or other
  modified_base (219)..(219): a, c, t, g, unknown or other
  modified_base (272)..(272): a, c, t, g, unknown or other
  modified_base (340)..(340): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggngagtcagggcattagcaattatttagcctggtatacaaacagaaaccaggganagttcctaagctcctgatctatgctcgcctccacgttaccacctcgacggggtcccatctccggttcnggcgacagtgaatcgtgggacagtgttcactctcactatcagcagctgaccagcctagagtattgtacgactaactttattactagtactaaaagtattaactactacgcccttactctacgtttacgggacgggtacggtaaccgaagggtacggaaacgtactaaccgaaacgaaccgttggtacgg

SEQ ID NO: 426134 - DNA, 619 bp, Homo sapiens
  misc_feature: GZ8MTXP02JDMM2.25.4.A04.1.454.CMB.2.raw
  modified_base (277)..(278): a, c, t, g, unknown or other
  modified_base (297)..(297): a, c, t, g, unknown or other
  modified_base (316)..(316): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttgggtacagccaggccggtccctgacactctcctgcacagcttccggactcacctttggnncatgctatcgcgtcggccncgagctcgagggaggtcgnggagtggtcgttggtacagttagaacgcgaacgtccctagtggggtacgggacaacacaacgtccggccgacgtacgtaaggtaaaacggcaagtacttaccgacgtaccctacgtacgaaaggaagtatacgtaaacttaaccgaaaagtacctaacgtacccgtaccttattccgtacgaccaactagtacgacgacgacgaccgtaggaagacgacggaacggacctcggacgtccgttagttacttacgttcgttacttaacgttactacgtacggtaggtacgttaggtttagtttac

SEQ ID NO: 426135 - DNA, 565 bp, Homo sapiens
  misc_feature: GZ8MTXP02GMY29.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccatccctccctgtctgctatcgtggttaggagacagaatcaagcatcacgttggccgggcgagtcgagggctattagctaattattagcctggtatacaacaagaaaccgagggagtagttaccaagcctccagtactctatcgactcgtcctaccaccgttacaccgtccgacggggtcccagttcgtccggttacgcgcggacaggtagaatcggtagggactagtagttcactcactaactatcaacgcgtagccctagccgtacgcgtagaaggtctggttactactaattaacgtatagaactaaagtactaactctccgtccctctacgtaccggttcgggaacgggacgaacggaaggtacgaagtacgaacaacggtacgtcggtacg

SEQ ID NO: 426136 - DNA, 502 bp, Homo sapiens
  misc_feature: GZ8MTXP02JQW9N.25.4.A04.1.454.CMB.2.raw
  modified_base (277)..(277): a, c, t, g, unknown or other
  modified_base (341)..(341): a, c, t, g, unknown or other
  modified_base (378)..(378): a, c, t, g, unknown or other
  modified_base (381)..(381): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgtggagacagaatcagcatcacgttggccgggcgagtcgagggctattagctaattatttagcctggtatacaaacgagaaaccgaggganacgttaccaagctcctgatctatgctcgcctcacgttacacctcgacgggtccatcgtcgttcnggcgcagtgatgaggacagtacgtcactcatacgtancancacgcacgcacgacgagagtagtagtatactacttatactataataataataactactactacctactacgtacgtacgtacggacggacgaagagacgacgacgaacgtacgtacgtacg

SEQ ID NO: 426137 - DNA, 784 bp, Homo sapiens
  misc_feature: GZ8MTXP02IE15C.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttggagacagaatcagcatcacgttggccgggcgagtcgagggctattagactaatttattagcctgtatacaacaagaaaccgagggagagttacctaagcctacctagtatcttagtcgtccgtcgtcccctaccgtaaccgttaaccaccccgttaccgaccggggttaccccctagttcccgttaccgggttaccacggggtccgggtaccgtaagggttacgtaaacgttcggttacgggggaaacctaacggggttagttacccgaaccttcttaacctaactttactaccgtaacgaccgaaccggtccccgtaaggtccgaaccggtacccggtaggtaaaacgtacgtttagggttaaccgtaaccgtttaaaccgttttaaacgttaacttaacgggttaaaactaaaaaacggtttaaacttaaaacttaaccccgttccgttacccccctttaaccgttcccggttaaaccggttttcccgggggaaaccggggtaaccgggtaaaacccggtaaaagggggttccggtaaaaacggttaccgtaaaaacggtaaaaccccggtaaaacggtggttaacccggg

SEQ ID NO: 426138 - DNA, 559 bp, Homo sapiens
  misc_feature: GZ8MTXP02G40G3.25.4.A04.1.454.CMB.2.raw
  modified_base (278)..(278): a, c, t, g, unknown or other
  modified_base (302)..(302): a, c, t, g, unknown or other
  modified_base (525)..(525): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtcctgacactctcctgcacagccttccggactctacctttggngagcatgctatcgacctgggtccncaggctcgaggggaggtctggagtggcttgggtcagttagagcgaagcctagtggtgggcaaacacagtccgccgcgtactagtaaaaggctaaggattcaacgtccctacgtacaaaggatagtagtaacttaccgaaaagtcaaagtccgacctattcagcaacatgagcagccaggaagaacggacgacggtactcgaaggtccgtagttaacttcgttnttaacttacttactcgtagagtacgtagtttaag

SEQ ID NO: 426139 - DNA, 658 bp, Homo sapiens
  misc_feature: GZ8MTXP02F1N7I.25.4.A04.1.454.CMB.2.raw
  modified_base (254)..(254): a, c, t, g, unknown or other
  modified_base (277)..(277): a, c, t, g, unknown or other
  modified_base (283)..(283): a, c, t, g, unknown or other
  modified_base (324)..(324): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttcctgttgctgttttaaaggtgtccaatgtgaggtgcaactggtggagtcgtgggggagcttgggtacagccagggccggtccctgacactctcctgcanagccttccggactcacctttggnagcatnctatcgacgtggccgcgaggctacggagggtaggtcgtggnggtggtcgttgggtctagttagagcgaagtccctagtggggacgggacaacaaccgaacgtcccgccgtacgttacgtaagtaaaacggctaagtactcgacgtccctactaacgaaagagtagtacgtaaacttaaccaaaacgactaactaccgtacctagtccgtacgaccaacgtagtacgacgaccgtacggtaccgaggaaacggaacggaccggtaacgggacctacggtacgggtacccgtttagtttaacgtttacgtttcgtttaactttaacgtttaccgttacgtacggtaacggttacggtttacggtttagttttaaacg

SEQ ID NO: 426140 - DNA, 555 bp, Homo sapiens
  misc_feature: GZ8MTXP02INDDR.25.4.A04.1.454.CMB.2.raw
  modified_base (280)..(280): a, c, t, g, unknown or other
  modified_base (480)..(480): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgtttaaaggtgtccaatgtgaggtgcaactgggtggagtcgtggggggagcttgggtacagccaggccggtccctgacactctcctgcacagccttccggactctacctttggngagcatgctatgacctgggtcccgcaggctccgaggggaggtctgggagtggtcttggggttcagtttagaaagcgaacgtccgtagtggggtaggggacaaacgacagtaccgccgcgtactagtaaaaggcagtattcagcctctcaaagagtatgattaaccaaaagcaatccgtacctactctgctaacatgacgnagcctaggacgaagcgaggactacacgccgtagtactttacttgttaacttagttctctagacgtagtagtttag

SEQ ID NO: 426141 - DNA, 548 bp, Homo sapiens
  misc_feature: GZ8MTXP02I2QYQ.25.4.A04.1.454.CMB.2.raw
  modified_base (221)..(221): a, c, t, g, unknown or other
  modified_base (270)..(270): a, c, t, g, unknown or other
  modified_base (275)..(275): a, c, t, g, unknown or other
  modified_base (313)..(313): a, c, t, g, unknown or other
  modified_base (398)..(398): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttcgccgggngagtcgagggcattagactaattattagcctggtatacaacagaaaccnggganagttcctaagctacctgatctatgctgcctcacgtacncctcgacggggtcccattcgtcggttcaggcgcagtgaagtcgtaggggactagacgttcactctacatatacacgtacagtccngacgcgtaccgtagtaagtagttcgttacgaccttaacttattactaagttaactaaaagtattaaacgtactccgtccctactcctacggtttcgggaccgggtacggaaccgtaaggtcggagacgtaacgaaacgtacgtcgtacgg

SEQ ID NO: 426142 - DNA, 528 bp, Homo sapiens
  misc_feature: GZ8MTXP02JHU7E.25.4.A04.1.454.CMB.2.raw
  modified_base (194)..(194): a, c, t, g, unknown or other
  modified_base (218)..(218): a, c, t, g, unknown or other
  modified_base (333)..(333): a, c, t, g, unknown or other
  modified_base (409)..(409): a, c, t, g, unknown or other
  modified_base (456)..(456): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccggngagtcagggcattagcaattatttagcctggtatcaacagaaaccgagggagagttccaagctacctgatctatgctcgcctccacgtacacctcgacgggtccatcgtcgttcngcgcagtgatcgtggacagtacgttcactcgtcactagcagcacgccgtgacacggcctgaaagtgttcggttaanccttaaactttattactactaaactaaaattaataaacttacgtccncccttctaccgtacgtttccgggacggtaacgggaccgtaaggtacggaagtacaacgaacgtaacgtgcgg

SEQ ID NO: 426143 - DNA, 582 bp, Homo sapiens
  misc_feature: GZ8MTXP02JFVS5.25.4.A04.1.454.CMB.2.raw
  modified_base (289)..(289): a, c, t, g, unknown or other
  modified_base (301)..(301): a, c, t, g, unknown or other
  modified_base (392)..(392): a, c, t, g, unknown or other
  modified_base (431)..(431): a, c, t, g, unknown or other
  modified_base (433)..(433): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaacgtggtggagtcgtgggggagcttggacagccaggccggtcctgacactctcctgcacagccttccggactcacctttggcgagcatgctancgacctggtccnccaggctaccgaggggaaggtctgggagtggctttggggtacagttagaagcaaacggcctagtggaggggcaaactacaagtccgcccgngttacgagtaaaaggcagtaatcgagcctcagagagaananactaacaaacacactacactactacacacacagacgacgacgacgtacgtacgaagaacggacggacggacgtacgacgtacgttacgttaacgttacttacgtttaacgtttacttacgttacgtagtacggttacggttaggtttag

SEQ ID NO: 426144 - DNA, 640 bp, Homo sapiens
  misc_feature: GZ8MTXP02HFY82.25.4.A04.1.454.CMB.2.raw
  modified_base (258)..(258): a, c, t, g, unknown or other
  modified_base (277)..(277): a, c, t, g, unknown or other
  modified_base (279)..(279): a, c, t, g, unknown or other
  modified_base (300)..(300): a, c, t, g, unknown or other
  modified_base (383)..(383): a, c, t, g, unknown or other
  modified_base (428)..(428): a, c, t, g, unknown or other
  modified_base (455)..(455): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggcccggtcctgacactctcctgcacngcttccggactcaccttgngngcatgctatgacctgggtccnccgaggctccgaggggaagggtctgggagtgggtcgtttgggttcagttagaagacgagtcctagtgggtggggacaaacganacgtaccgccgtcgtactagtaaaaggcagtattcagtcctctanaagtagactagtaacttaaccgaaaanctactccgtactactcgtacgacactacgtagacgacgacgtaccgtaggaacgaacggtacggaacggtaccgtacggtaaccggttcggtttaacgtttaactttaccgtttacgttttaaccgtttaacgtttaaccgttacgtaagggttaacggtttaacggttttaacggtttaaacgg

SEQ ID NO: 426145 - DNA, 680 bp, Homo sapiens
  misc_feature: GZ8MTXP02FMTPH.25.4.A04.1.454.CMB.2.raw
  modified_base (222)..(222): a, c, t, g, unknown or other
  modified_base (468)..(468): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctcctgtctgcatctgttggagacagaatcagcatcacgttggccgggngagtcgagggctagttagactaaatttatttacgaccgttaggtaactaccgaaaacgtaacggaaaaccgaggggtaatacggtttaccctaaaggtccttaccgtagtaacttctagtcgtccttcgtacccctacctaacgttacacccgtcggaccgggtcctagttcgtcggttacacgggcggactaaggtacgaacgttcgggagggaactaggtactttaccactactactaacttanaccgagccacgacccgtgaaccgtacgtaccggtaagtaagttagtttcggttaactaacctttaaatttacttaacgtaagtaaaactaaaagttaactaaaccttccgaccttaccccttcgttaaccggttaacgtttacgggggaacgggtaacggtaaccgtaagggggtacaaacgtaacgtaaacgtaaaacggtcttggaccgg

SEQ ID NO: 426146 - DNA, 656 bp, Homo sapiens
  misc_feature: GZ8MTXP02GNJIX.25.4.A04.1.454.CMB.2.raw
  modified_base (306)..(306): a, c, t, g, unknown or other
  modified_base (383)..(383): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtcctgacactctcctgcacagcttccggactctacctttggtgagcagtgctatcggacctggggtcccnccagggcctaccgaggggaggtctgggagtgggtcttgggttcagttagaagcgaagcctagtgggtggggaccaanacgagtaccgcgtacgtcgtaaggtaaaacggctaagattacgaacgtccctacgtacgaaagagactaggtaacttaaccaaaaacggtcctaaacgttcccgtaccttacttacctacggacctaacagtagggaacgaccgaacgcccggttaggaaacgggaaacggaccgggaacgggtactaccggaaacgggttcccggttattaacgtttacctttaggtttaactttacgtttacctcgtaggtagtacggtttaggttttaag

SEQ ID NO: 426147 - DNA, 588 bp, Homo sapiens
  misc_feature: GZ8MTXP02IK999.25.4.A04.1.454.CMB.2.raw
  modified_base (283)..(283): a, c, t, g, unknown or other
  modified_base (306)..(306): a, c, t, g, unknown or other
  modified_base (434)..(434): a, c, t, g, unknown or other
  modified_base (479)..(479): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgtcttttccttgttgcttagttttaaaaggtgtccaatgtgaggtgcaactggtggagtcgtggggggagcttggtacagccaggcccggtccctgaccactctcctgcacagccttccggactctacctttggngagcatgctatgaccgtgggccncaggctccgaggggaaggtctgggagtggtcgtttgggtcagttagaaagcgaagcctagtgggtgggacaaacacagtccgccgcgtactaggtaaaaggcaagacttcacgtcctactacaaaganagtacgtaacttaaccaaaaagctagtacccgtacctaatcctancaaccagtagacgcacgccgtagagaacgcggaaggctacgaacgccgttagttaactttactacgtttaactttacttacgttacgtagtagttacgttagtttaagg

SEQ ID NO: 426148 - DNA, 627 bp, Homo sapiens
  misc_feature: GZ8MTXP02JHIWR.25.4.A04.1.454.CMB.2.raw
  modified_base (223)..(223): a, c, t, g, unknown or other
  modified_base (436)..(436): a, c, t, g, unknown or other
  modified_base (484)..(484): a, c, t, g, unknown or other
  modified_base (616)..(616): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctcctgtctgctatctgttaggagacagaatcagcatcacgttggccggngagtcgagggctattagactaatttattagctaggtatacaaacgaagaaaccgaggacgtacgttaccaagtctacctgattctagtgcctcgacctaccgtaacgttaccaccgtaccggacgggtcccctagttccgtacggttacacgggcggtacctaggtacgacgtacgtaggggaactaacgggtactcgtactcctatacttanacacgtacacggacctaggaaaccgtgtaaagaagtagttccggttanaacttaaacttagttaaatacgttaaaagtaaaacttaacgtaaaactaccgtaccgtacccttacgtaccgttaacggttacggggaccggtaacgggaagtaagggtaagaggtaaacacgtaaaacgtntacggacgtac

SEQ ID NO: 426149 - DNA, 566 bp, Homo sapiens
  misc_feature: GZ8MTXP02FJNOB.25.4.A04.1.454.CMB.2.raw
  modified_base (250)..(250): a, c, t, g, unknown or other
  modified_base (318)..(318): a, c, t, g, unknown or other
  modified_base (355)..(355): a, c, t, g, unknown or other
  modified_base (413)..(413): a, c, t, g, unknown or other
  modified_base (450)..(450): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttggtacagccaggccggtccctgacactctccngcacagcttccggactcaccttggtgagcatgctatgacctgggtccgcaggctccagggaagggtcnggagtggctgggtcattagaagcgaagcccctatggnggggcaacacaatacgccgcgtctagtaaaaggcagattcagccctctacaaagagangaattaccaaaagccaatcgcctaatcctagcaacanagagacgacgacgagaagaagacggaacggacgtacgacgtaccggtacgttacgttacttacgtttacttaacgtttaacgttacgtacgtagtaaggttaaggttaggtttaag

SEQ ID NO: 426150 - DNA, 690 bp, Homo sapiens
  misc_feature: GZ8MTXP02J0O1N.25.4.A04.1.454.CMB.2.raw
  modified_base (220)..(220): a, c, t, g, unknown or other
  modified_base (253)..(253): a, c, t, g, unknown or other
  modified_base (484)..(484): a, c, t, g, unknown or other
  modified_base (493)..(493): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggcctcccagataccagatgtgacgtccagatgacccagtctccatccctcctgtctgctatctgttgagacagaatcagcatcacttggccggngagtcgaagggtctaagttacgactaaagtttnttaacgccttaggtaactaccgaaacgaacgaaaaccggtaggggtaataccggtttaacccaaggtcccttaccgtagtaacttccgtagtcgtcctacgtccccttaaccgtaccgtttaccaccccgttccgggaaccggggttccccctaagttccgttacggttacgacggccggtactaggttacgaacgttcggtagggaactagtacgtctacgtctacactntcgaacgtnaccgtctagcgtacgtcgtaagtaactagttcgtacgtaacttaaacgtttaacgttacgtaaagttaaacgtaaaagtttacttaaacttacccggtccctacccgttacgttacccgtaacggtttccggggaaccggtaaccggaaaccggtaaggtacggaaagacccttaacgaaacggtacgttcggtacg

SEQ ID NO: 426151 - DNA, 603 bp, Homo sapiens
  misc_feature: GZ8MTXP02JQTGY.25.4.A04.1.454.CMB.2.raw
  modified_base (279)..(279): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgctatctgttggagacagaatcagcatcacttggccgggcgagtccgagggcattagactaattattacgcctggtactacaacagaaaccgagganagtacctaagcctctgactctatgctcgacctacctacgttaccacccgtccgacggggttacccagttccgtacggttcacgggtccgacgtaggtagaattcgagggtacaggtacttactacttctctaacttacaccgacgtaccgacgtccgtacggaccacgtccgtagtaagacgttaggtacctacttaacctttattaacgtataaacgtaaaattaactaactacctacctccctactaccgttaccgttaccggggacgggaacggtaccggaaggtacggtaacgaacgtaacgaaacgtaacgtggtacgg

SEQ ID NO: 426152 - DNA, 670 bp, Homo sapiens
  misc_feature: GZ8MTXP02G1UJI.25.4.A04.1.454.CMB.2.raw
  modified_base (280)..(280): a, c, t, g, unknown or other
  modified_base (304)..(304): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactgggtggagtcgtgggggaggcttggtacagccgaggccggtccctgacactctcctgccacagtccttccggactctaccgtttggngagcatgctagcgaccgtggtccncgaggcctccggaggggaggtctaggaggtggcgtttgggtcagttagaagtcgaaacgtcgtagtggggtcgggactaaacacaagttaccgccggtcgtacgtaaggtaaaacgcgtaagtacgttccgaacgtccctacgtaacgaaaggtaaggtattaacgtaacttaaaccccgaaaaagtccctaaactccggtaaaccctattaccgtcgaaccacctaagtacggacggacaacgtcccgaggaaccggaaggtacgaacggtacctcggaaacgtccggtagtttaaactttccgttagttttacttacgttaaccttgaggtaagtagttaccggtttaggtttaattttaaacg

SEQ ID NO: 426153 - DNA, 712 bp, Homo sapiens
  misc_feature: GZ8MTXP02FO39M.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggaggtcttggtacagccaggcccggtcctgacactctcctgcacagccttccggactctaccgttggtgagctagtgctagtcggacccgtggggtccccgccgagggcctaccggaaggggtaacgggtcgtgggaggttgggtcgtttggggttacagttaaggaaacggtcgaaacggtcctagtggggtacggggacaaaccgaacgacgtaccgcccggtacgtacgtaaggtaaaaacgggcaaggtacttacgaacgtaccctacgtaacgaaaggtaagtagtacgtaaacttaccgaaaaaacgcctaaacgtccgtaccttactacgttacggactaacgactagggacgacgacggtcccaagggaaaggaacggacggaaacgggtacctaccgaacgggtaccggttagtttaaaccgttacttttacggttaaccgtttagtttaccttacgttaggtaagttacggtttaaggttttaag

SEQ ID NO: 426154 - DNA, 637 bp, Homo sapiens
  misc_feature: GZ8MTXP02HSEHB.25.4.A04.1.454.CMB.2.raw
  modified_base (280)..(280): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccggtccctgacactctcctgcacagccttccggactccaccgtttggngagcatgctatgacccgtgggtcccgccgaggcctccgaggggaggtctggagtggcgtttgggtcagttagaagcgaagtcccctagtggggtgggacaaacaccgaagtccggccgtacgtactaggtaaaaagggcaaagtacttcagtccctctacgaagagtatagtaacttaaccgaaaagcctaagtccgaccttaatctgcacagtagagcgagtccgaggaagaaacggcggaacgggtaacctcggaaaccgtcccggtttaggttaacttaccgttttacgtttacttttaacgttaaaccttcgttacggaaggttacggtttaacggtttagggtttttaaaac

SEQ ID NO: 426155 - DNA, 587 bp, Homo sapiens
  misc_feature: GZ8MTXP02IT5VH.25.4.A04.1.454.CMB.2.raw
  modified_base (295)..(295): a, c, t, g, unknown or other
  modified_base (460)..(460): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttggcttaactgtcttttccttgttgctgttttaaaggtgtccaatgtgaggtgcaactggtggagtcgtgggggagcttggtacagccaggccggtccctgaccactctcctgcacagcttccggactcacctttggtgagcatgctatgacctgggtccnccaggctccgagggaggtctggagtggcttggggttcagttagaagtcgaaagtcctagtggtggggacaaacgacaaacgttaccgccgtcgtacgtagtaaaaagggccaaggtattcagtcctctacaaagagatagacttaccaaaagtcatcgacttacnctacgcacagagacgacgacgacgtacgagaagacgacggacgtacgacgtacgttacgttacgttacgttacgttactttacttaacgttacgtacgtacgtagttagttacgtttaactttaacg

SEQ ID NO: 426156 - DNA, 665 bp, Homo sapiens
  misc_feature: GZ8MTXP02FLGO9.25.4.A04.1.454.CMB.2.raw
  modified_base (278)..(278): a, c, t, g, unknown or other
  modified_base (288)..(288): a, c, t, g, unknown or other
  modified_base (300)..(300): a, c, t, g, unknown or other
  modified_base (343)..(343): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaacgtggtggagtcgtgggggagcttggtacagccaggcccggtccctgaccactctcctgcacagccttccggactctacctttggnagcatgctancgacctgggccncaggcctcgagggaggtctggagtggcttgggtcagttagagngaacgctagtggggtcgggacaaacgactaacgtaccgccgtacgtacgtaacgggtaaaaagcctaaggtatttccgacgcccttactacgaaaggtacaagttacgtaaacttaacccgaaaaagtctaaactcccggtacccttaacgtccttacggcctaaaccgtagtacgaacgccgaacgacccgtagggaacgaacggtacggaacggtaaccttcggaacgttcccggttagttaacttttaccgttacgtttccttttaattaaccgtacgttaggtacggttaaggtttacgttaggttttaactttaaac

SEQ ID NO: 426157 - DNA, 598 bp, Homo sapiens
  misc_feature: GZ8MTXP02IRDOA.25.4.A04.1.454.CMB.2.raw
  modified_base (282)..(282): a, c, t, g, unknown or other
  modified_base (305)..(305): a, c, t, g, unknown or other
  modified_base (362)..(362): a, c, t, g, unknown or other
  modified_base (559)..(559): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagttgggcttaactgttcttttccttgttgcttagttttaaaaggtgtccaatgtgaggtgcaacgtggtggagtcgtgggggagtcttggtacagccaggccggtccctgacactctcctgcacagccttccggactcacctttggnagcatgctatcgacctgggtccnccgaggcctcgaggggaggtctggagtggtcttggttcagttagaagcaagcctagngggtagggacaacacagtaccgcgtacgtcgtaaggtaaaagcaagtacttacagccctctacaaagtagactgaaacttaccgaaaagccaatccgtactattcgtagacctaacagtacgacgaccgacggtaccgaggaaacgaacggacggaacgggtacctcgaaacggttccgtagtttaacttaccgttntttaacttattaacttcgtagtaggttagttagtttaag

SEQ ID NO: 426158 - DNA, 666 bp, Homo sapiens
  misc_feature: GZ8MTXP02ITI6T.25.4.A04.1.454.CMB.2.raw
  modified_base (311)..(311): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactgggtggaggtcgtgggggagcttggtacagccagggccggtcctgacactctcctgcacagccttccggactctacctttggtgagcatgactagtgaccgtcggggtccnccgaggtcctccgaggggaacggtctgggagttgggtcgtttgggttctaagttaggaagcggtaacgcctagtgggtggggacaacgaacagtaccgccgcgtctaggtaaaaggcaagattcaacgtcctactacgaaagagtatagtaacttaaacccgaaaaagctaacgtacccgtacctaattccgtacgacaacctagtcggacgacgaacgccgttaggaaaggaaacggtcggaacgggtacctaccggtaacgtaccggtttacgttaaacgttttaccgtttagttttaacgtttaacgtttaaccttacgtaggtaaacggttacggtttaaggttttaacgg

SEQ ID NO: 426159 - DNA, 720 bp, Homo sapiens
  misc_feature: GZ8MTXP02JNC3L.25.4.A04.1.454.CMB.2.raw
  modified_base (280)..(280): a, c, t, g, unknown or other
  modified_base (304)..(304): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccgaggccggtccctgacactctcctgcacagccttccggactcacctttggngagcatgctatcgacctgggtccncaggctcgaggggtaggtctgggagtggtcgttgggtcagttacgagcgaagccgtagtggtacgggacaaacacgaagtccgcgtacgtcgtaaggtaaaacgcaagtacttcgaacggtccctacgtacgaaagtaagtactaacgtaaacttaaacccgaaaaagcctaaacgttcccggtaacccttaaacgttcccggttaacgtaaccgtaaacgtagtaacggaacgaccggtaacggtaccggaaggggaaaacggaacgggtaaccgggtaacggtacccgtaaccgggtaccggtttaccgtttaacgtttaaaccgtttaccgttttacgttttaaccgtttaaacgtttaccggttaacggttaagggttaaacgggtttaacgggtttaacggttttaaacgg

SEQ ID NO: 426160 - DNA, 613 bp, Homo sapiens
  misc_feature: GZ8MTXP02IXXGA.25.4.A04.1.454.CMB.2.raw
  modified_base (194)..(194): a, c, t, g, unknown or other
  modified_base (204)..(204): a, c, t, g, unknown or other
  modified_base (219)..(219): a, c, t, g, unknown or other
  modified_base (258)..(258): a, c, t, g, unknown or other
  modified_base (350)..(350): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttgganacagaatcancatcacgttgccggngagtcgaggcattagactattattagcctggtatacaanacgaaaccgagggatagttacctaagctctagatctatcgctcgcctaccacgttacacccgtcgacgggtaccccagttccgtacggttcnggcgtacagtagtaactcggtagggaacaggttacttccactctactactagtccaagcacgcctgacgacgtcctaaggaacgttactagggttactacccttaaagttttacttaacgttaaggtaaacctaaaagtttactaaaactttaacccgtcgttacccccttcgttaccgtaaccggttttccggggaacgggtacggtaaacccgtaaggggaggtaacgtaaacgtaacgtaaaacgtccggtttagaccgg

SEQ ID NO: 426161 - DNA, 647 bp, Homo sapiens
  misc_feature: GZ8MTXP02GLU0O.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttggtacagccaggccgtccctgacactctcctgcacagtcttccggactctaccgttggtgagcatgctatcgaccgtgggtcccaccgaggcctaccggaaggggtaacgggtcgtaggggtaggtgggtccgtttggggttacaagttaggaaacggtaccggaaacggccttaagtcggggtacggggacaaacgacaacgtaccgccggtcgtacgtaaggtaaaaacggcaagtattcacgtcctctacgaagagatagaacttaaccaaaagcaactcgtacctatctagactacagtaggacgacgacgccgtaggaacgaacggacggaacggtacctacgaacggtcccgttagttaacctttacgttacgtttaactttaacgttactacgtaggtaacgtaggtttaaggtttaagg

SEQ ID NO: 426162 - DNA, 517 bp, Homo sapiens
  misc_feature: GZ8MTXP02FGGQ1.25.4.A04.1.454.CMB.2.raw
  modified_base (397)..(397): a, c, t, g, unknown or other
  modified_base (431)..(431): a, c, t, g, unknown or other
  modified_base (439)..(439): a, c, t, g, unknown or other
  modified_base (446)..(446): a, c, t, g, unknown or other
  modified_base (479)..(479): a, c, t, g, unknown or other
tcagactgtacagtcacgaccggtgctcgatttagagtagtgatcagggggctctggggagaggagccccagccgtgagattcccaggagtctccacttggtgatcagcactgaacacagaccaccaaccatggagtttgggcttaactgtcttttccttgtgctgttttaaaaggtgtccaatgtgaggtgcaactggtggagtctgggggagcttgggtacagccaggccggtccctgacactctcctgcacagcttccggactcacttggtgagcatgctatgacctgggtccgccaggctccgaggggaggtctggagtggctgggtcattagagagaagccctagtggtggggcaacacaatcgccgcgtctgtaaaagcagattcagcctntacaagagatgattacaaaagcatcgcctatctncacatgancagtccngacgagcgaggtactgacgccgtagtacttacngtttactaagttactctagagtagtaacgtggtttaaa

SEQ ID NO: 426163 - DNA, 714 bp, Homo sapiens
  misc_feature: GZ8MTXP02FJYB8.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtggggggaggcttgggtacagccaggcccggtccctgacactctcctgcacagcttccggactcaccgtttggtgagcatgctatcgaccgtgggtccgccaggcctccgaggggaaggtcgtgggagtgggctttggggttcagttagaacggtcgaaacgccgtagtggggtcggggacaaacgactagtaccggccgtacgttaccgtaaggttaaaaacggggctaaggtactttacgacggtccctacgttaccaaaaggagtaataggtaaactttaccaaaaaacgtcgtaaactcccggaccctttaagtccttacgacctaaccaacgttggaacggacgacggacccgtacgggaaggaaaacggtccgggaaaacggggtacctaccggtacggtaccccggttaggtttaacgtttaacccttttaggttttaacttttacgtttaaccttacgttaggttaaacggttaacggtttacgggtttttaaacgg

SEQ ID NO: 426164 - DNA, 530 bp, Homo sapiens
  misc_feature: GZ8MTXP02JFWUJ.25.4.A04.1.454.CMB.2.raw
  modified_base (194)..(194): a, c, t, g, unknown or other
  modified_base (265)..(265): a, c, t, g, unknown or other
  modified_base (270)..(270): a, c, t, g, unknown or other
  modified_base (284)..(284): a, c, t, g, unknown or other
  modified_base (291)..(291): a, c, t, g, unknown or other
  modified_base (417)..(417): a, c, t, g, unknown or other
  modified_base (424)..(424): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgganacagaatcagcatcacttgccgggcgagtcgagggcattagcaattatttagctggtatcaacagaaaccnggganagtcctaagctacngatctangctcgcctacacgttacaccgtcgacggggtccccattcgtcggttcaggcggcaggtcgaattcgtggggaacacgtgttcctactcactaacctatcaacgcagccctgctagcctagaacgtntggttanactaacttattaactaagtaactaaaatataactactcaccctcgtactacgtttcggacggacggtaccgaaggtagagtacgtacgaaaacgtacgtaggtcgg

SEQ ID NO: 426165 - DNA, 626 bp, Homo sapiens
  misc_feature: GZ8MTXP02JNMRT.25.4.A04.1.454.CMB.2.raw
  modified_base (281)..(281): a, c, t, g, unknown or other
  modified_base (441)..(441): a, c, t, g, unknown or other
  modified_base (450)..(450): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggagcttgggtacagccaggccggtccctgacactctcctgcacagcttccggactctaccttggtgngcatgctatcgaccgtgggtcccgccaggcctccggaggggtaacggtcgtgggaggtgggtcgttgggttcagttagaacgtcgaacgtcctagtggtcggggacaaacacgataccggcgtacgtactaacggtaaaaggcaaggtattcacgccctntacaagganatagtaacttaaccaaaagctaactccgaccttactctagcaaactgtacgacgacacgacgtagaacgaacggacggaacgtaccgtacgacggttaccgttagtttacctttacgtttacgtttaacgtttaacgttaccgttacggtagtaaggttaacgtttaacgtttaag

SEQ ID NO: 426166 - DNA, 564 bp, Homo sapiens
  misc_feature: GZ8MTXP02G7ZW2.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacagcttccggactctacctttggtgagcatgctatcgaccgtgggtccgccgaggcctccgaggggaggtctggagtggcgtttgggtcagttagagcgaagcctagtgggtgggacaacgacaactcgccgcgtctaggtaaaagcaagtacttcgacgccctactacgaaagagatagacttaaccaaaagcaacgtcgaccttatctgacacagtagacgcgacgccgtagaggaacgcgaggacctcgagtccgttagtactttacttgttacttatctcgtagagtagtagtttagttaatttaacg

SEQ ID NO: 426167 - DNA, 693 bp, Homo sapiens
  misc_feature: GZ8MTXP02F3LK2.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactcctccctgtctgcatctgttggagacagaatcagcatcacgttggccgggcgaagtcgagggctattagactaattatttagcctggtaatacaaacaacgaaaaccgagggaacgtacgttacctaaaggctacctagtatcctatcgctcgtcctactacgttacaccgtaccgacggggtccctagttacgtcggttacagggcggacgtagtacgaacgtacggtagggtaacgaggtacttacctacctactactaacttaactacaacgcgtaacgccgtacgacgacgtacccgtaggtaagtagttacgggttaactaaccttaaaacgtttaactttaaccggttaagttaaaaccttaaaaaaggttaaacttaaaacttaacccgttaacccgttccccttaaccttaccgttaacccgggtttacgggaaccgggggttaacggaaaccggtaaacggggtaggggtaaacaaacgttaaccgaaaacggtacggtacggttaacggg

SEQ ID NO: 426168 - DNA, 538 bp, Homo sapiens
  misc_feature: GZ8MTXP02GBX5D.25.4.A04.1.454.CMB.2.raw
  modified_base (347)..(347): a, c, t, g, unknown or other
  modified_base (355)..(355): a, c, t, g, unknown or other
  modified_base (386)..(386): a, c, t, g, unknown or other
  modified_base (468)..(468): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacttggccgggcagtcgagggcattagactaattattagcctggtatacaacaagaaaccagggaagtagttacctaagctcctagtatctatgctacgcctccacgttacaccgtcgacgggtccactctcggttcngcgcagtnaagtcgtgggacagacgttcactctcatacncacgcacgctcgcgacgccgtagacgtattacgttgaacctaatttattactagtaactaaaagtaattaaactacgtaccncccttactactacgtttaccggacgggtacggaaccgaaggtacggagactacgaaaccgtagtagtcgg

SEQ ID NO: 426169 - DNA, 643 bp, Homo sapiens
  misc_feature: GZ8MTXP02HRRN9.25.4.A04.1.454.CMB.2.raw
  modified_base (285)..(285): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaggtgtccaatgtgaggtgcaactggtggagtcgtgggggagtcgttggtacagccaggcccggtccctgaccactctcctgcacagccgttcccggactctaccgtttggngagcatgctagtcgaccgtcgggtcccgccgaggccgtcgaggggaagggtcgtgggacgtggtcgtttgggtcagttagaagcgaagcccgtagtgggtcgggacaacacaagtaccgccgtcgtacgtagtaaaaggccaagtacttcgacgtccctcgtaaccgaagtacgtatacggtaacttaacccgaaaacgctacgtaccgtaccttatcgtagactacgatcgagaccgagtccgagaacgacgacgacggtacctacgtacggtaccgttagttaacgtttacgttacgttttactttaacgttaccgtacgtttacggaggttacggtttagtttggtttttaaaac

SEQ ID NO: 426170 - DNA, 669 bp, Homo sapiens
  misc_feature: GZ8MTXP02FTC7L.25.4.A04.1.454.CMB.2.raw
  modified_base (220)..(220): a, c, t, g, unknown or other
  modified_base (276)..(276): a, c, t, g, unknown or other
  modified_base (402)..(402): a, c, t, g, unknown or other
  modified_base (416)..(416): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttggccgggngagtcagggcattagctaattattagcctaggtatacaaacgagaaaccgaggganacgttaccgtaaagctacctagacttctatcgactcgcctccgtaacgttacaccgtccgacgggtcctagtctccggttcacgcggcagtgaatcgtgggacagtagttccactctacaactacnccgaagcacgtccncgacacggtacctaggtaagtacgtttagggttacaacctttaaacgtttaactttaacgttaacgttaaaccggtaaaaaagttactttaaaaccgttaacccgttcccgttaccccctttacgtttaaccctttaaccggggttttacccgggggaaccgggggaaacccggggttaaaacccggaaggggtttaaccggaaagttaaaccggttaacccgaaaaacgggtacccgtttgggtaaaccggg

SEQ ID NO: 426171 - DNA, 603 bp, Homo sapiens
  misc_feature: GZ8MTXP02F7LR5.25.4.A04.1.454.CMB.2.raw
  modified_base (195)..(195): a, c, t, g, unknown or other
  modified_base (221)..(221): a, c, t, g, unknown or other
  modified_base (388)..(388): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttgganacagaatcagcatcacttggccgggnagtcgagggcattagctaattattagcctggtatcaacagaaaccgaggagagttcctaagctacctgtactctatcgctcgcctcacgttacacctcgacgggtccagtcgtcggttcaggcgcagtagaatcgtagggactaagtgttaccactctactacttancagcagcccagctacgccgttagaaagtgttacggttacgtaaccctaagttttaacttaccgtttaaacggtaaacgtaaaaagttttaacaaaacgtttaacctcccggtaacccccttcgtttaaccgtaccggttttacggggaccgggaacggggttaaaccgaaggggttagaacgtaacgttacgaaaaccggtaaggtcggttacgg

SEQ ID NO: 426172 - DNA, 599 bp, Homo sapiens
  misc_feature: GZ8MTXP02HQ77Z.25.4.A04.1.454.CMB.2.raw
  modified_base (497)..(497): a, c, t, g, unknown or other
tcagactgtacagtcacgaccggtgctcgatttagagtagtgatcagggggctgggagaggagccccagccgtgagattcccaggagtctccacttggtgatcagcactgaacacagaccaccaaccatggagtttggcttaactgtcttttccttgttgctgttttaaaaggtgtccaatgtgaggtgcaactggtggagtcgtgggggagcttggtacagccaggccggtcctgacactctcctgcacagccttccggactctacctttggtcgagcatgctatcgacccgtgggtcccgccgaggcctccggaggggtaagggtcgtagggaggtgggtcgtttggggttcaagttaaggaaagtcgaaagtcctagtggggtaggggacaaacgacaactacggccgtacgtctaggtaaaacggctagatttcacgtcctctacaaagagatagtaacttacaaaagcagtcacttatctgcacatgagacngccgtaggaagacgcggaacggtactacgacgccgttagttaactttctacgtttacttattaacgtctaggtacgtagtttacgttagtttaactttaacg

SEQ ID NO: 426173 - DNA, 551 bp, Homo sapiens
  misc_feature: GZ8MTXP02H77S4.25.4.A04.1.454.CMB.2.raw
  modified_base (283)..(283): a, c, t, g, unknown or other
  modified_base (480)..(480): a, c, t, g, unknown or other
tcagactgtacagtcacgaccggtgctcgatttagagtagtgatcaggggagctctgggagaggagcccccagccgtgagattcccaggagtctccacttggtgatcagcactgaacacagaccaccaaccatggagtttgggcttaactgtcttttccttgttgctgtttaaaggtgtccaatgtgaggtgcaactgggtggagtcgtggggggagcttgggtacaggccagggcccggtccctgaccactctcctgcacagcttccggactcacctttggngagcatgctatcgacctgggtccgccagggcctccgaaggggaggtctgggagtggcttggggtcattagagcgaagcctagtgggtggggacaaacacagtaccgcccgacggttctagggtaaaagggcctaagtattcgacgcctctacaagagatagacttaccaaaagcactccgcctatctgacacatgancagcctagagagcgacgactcgagccgtatacttcttgttctttattacttcgtagagtagttagtttagg

SEQ ID NO: 426174 - DNA, 768 bp, Homo sapiens
  misc_feature: GZ8MTXP02HCCCE.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgctatctgttggagacagaatcagcatcacgttcggccgggngagtcgagggcattagactaattattagcctggtataccgaaacaagaaaccgtagggaagtagtttaccgtaaaggtcctaccgtagtattccttaatcggtccttccggtaccccttaccgtaaccggtttaacaccccgtaccgtaccgggggttaccccctagttcccgttaccgggtttacacggggtccggacgtaacggtacggtaaacgttccgggtaggggaacccgtaagggtttacgttaccctaaaccttccgtttacaaaccgttacttaccgaacgtcccgaaccgtcccgttaggacccgtaccggtacccgtaacggttaaacgttagtttacgggtttacgtaaacctttaaaacttttaaccggtttaaacttaaccgtttaaaacggtaaaagtttaacttaaactttaaaccggtcccgttaccctaccgtttaccgtaaccggtttaccgggggaaccggacgggtaaaccgtaaggggtacgtaacgtaaacgtaccggtaaaacgtaccggtaggtacccgg

SEQ ID NO: 426175 - DNA, 761 bp, Homo sapiens
  misc_feature: GZ8MTXP02G0G3J.25.4.A04.1.454.CMB.2.raw
  modified_base (283)..(283): a, c, t, g, unknown or other
  modified_base (310)..(310): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccaggccggtccctgaccactctcctgcacagcttcccggactctacctttggngagcatgctatcgaccgtcgggtcccnccaggcctccggaggggtaacggtcgtaggggaggttcgggtcgtttggggttacctaaagtttaaggaaacggtaccggaaacggtcccgttaaggttcgggggtacgggggaaccaaaaccgaacaacgtacccggccggtaccgttacgtaaagggtaaaaacgggctaagtacttcgaacgtccctactacgaaagagtaatagtaaacttaaaccgaaaaagcctaaacgtcccgtaccttaacttccgtacgactaaacctaagtaggaacgacgaacgtacccggtaaggaaaagggaaacgggaccggaaacgggtaacccttacggaaccgggttaccccggtttaaggtttaacctttaacccgtttggttttaaaccgttttactttaacccgtttacgtacgggtaaacggtttaacggtttaacgggtttttaaacgg

SEQ ID NO: 426176 - DNA, 578 bp, Homo sapiens
  misc_feature: GZ8MTXP02F2OGA.25.4.A04.1.454.CMB.2.raw
  modified_base (245)..(245): a, c, t, g, unknown or other
  modified_base (284)..(284): a, c, t, g, unknown or other
  modified_base (449)..(449): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaacgtggtggagtcgtgggggaggcttggtacagccgaggcccggtccngaccactctcctgcacagcttccggactctaccgttggnagcatgctatcgaccgtggtccgccgaggcctccgaggggaaggtcgtggaggtggtcgtttggggtactaagttaagaacgcgaacgtccgtagtgggtacggggacaaacgacgacgtaccgccgtcgtactaggtaaaaggcagtatcacgcctcacaaganatagacttaacaaagcacgtcgacctatctgacacagtgagcaacgcctagacgaaggcgaacggactacgacgtccgtagttactttacgttgttaaccttattcgtacgtagtagtagttagtttag

SEQ ID NO: 426177 - DNA, 585 bp, Homo sapiens
  misc_feature: GZ8MTXP02JOKAI.25.4.A04.1.454.CMB.2.raw
  modified_base (196)..(196): a, c, t, g, unknown or other
  modified_base (374)..(374): a, c, t, g, unknown or other
  modified_base (412)..(412): a, c, t, g, unknown or other
  modified_base (418)..(418): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccatccctccctgtctgctatctgtgganacagaatcagcatcacttggccggcgagtcgagggcagttagctaattattagccttggtatacaaacgaacgaaaccgagggagtacgttacctaaagcctacctagatctatgctcgcctccacgttacacgtccgagggtcccagtcgtcgttcagtcgcagtagactcgagganagtagttacactctactacgtatccgacacacgtcccngacccngtaccgtaggaaactgttacgtacgtaactaaaccgtttattaaccgtagttaaaccgtaaaagttactaacgttacgtaccgtaccccttacgtaaccgtcggtttaccggaccggggtaggaaccggtaagtacggtagtacgtaacgaaccgtagtcggtacgg

SEQ ID NO: 426178 - DNA, 845 bp, Homo sapiens
  misc_feature: GZ8MTXP02FKOMY.25.4.A04.1.454.CMB.2.raw
  modified_base (223)..(223): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatcctccctgtctgcatctgttggagacagaatcagcatcacgttcggccgggngagtcgagggactagttagactaattatttagccgttaggtatacaaacgaacggaaaaccgaggggaacgtaggtttaccctaaaggtccttacccgtaggtacttctacgtcgccgttacgtaccccttaccgtaaccggtttaccaaccccgttacccgggtaaccgggggttccccctaagttacccggttccgggtttaccgacggggtccggggacctaaagggttacggtaacgttaccgggtagggggtaaaccctaaaggttacggtttacccaaccttccgttactaaaccgttactaccgaaacggcccgtaacgggtccccttaggcccgaaaccggtaccgttaagggaaaacgttagtttacggtttaaccgtaaaccgtttaaaacctttttaaactttaaacgtttaaacgggtaaaaaccttaaaaaagtttaatttaaaaccgttaaccttccccggttaccccctttacccgttaaccggtttaacccgggttttacccggggggaaaccggaaccggggggttaaaacccaaaggggggtacggttaaaaccgaaacgttaaaacccggaaaaaacgggtttccgttaggggttaacccggg

SEQ ID NO: 426179 - DNA, 583 bp, Homo sapiens
  misc_feature: GZ8MTXP02FY4W9.25.4.A04.1.454.CMB.2.raw
  modified_base (295)..(295): a, c, t, g, unknown or other
  modified_base (316)..(316): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtcctgacactctcctgcacagcttccggactcacctttggtgagcatgctatgacctgggtccnccgaggctccgagggaggtcnggagtggtcttgggtcagttagaagcgaaagcctagtgggtggggacaacacaatccgccgcgtactaggtaaaagcaaggacttcgacgccttacgtacaaaggagtagtagaactttaaccaaaagcaagtccgacctaatcctagccaccatgaagcaagcctagagacgacggaggacctacgagcccggttattaacttaccttagtttacctttattaaccgttcgtaggtacgtacggttaagtaggttttactttaaac

SEQ ID NO: 426180 - DNA, 757 bp, Homo sapiens
  misc_feature: GZ8MTXP02JY6YT.25.4.A04.1.454.CMB.2.raw
  modified_base (285)..(285): a, c, t, g, unknown or other
tcagactgtacagtcacgaccggtgctcgatttagagtagtgatcagggggctctggggagaggagccccagccgtgagattcccaggagtctccacttggtgatcagcactgaacacagaccaccaaccatggagtttgggcttaactgtcttttccttgttgctagttttaaaaggtgtccaatgtgaggtgcaactggtggagtcgtgggggaggcttggtacagccagggcccggtccctgacactctcctgcacagccttccggactcctaccgtttggngagcatgctatcggacctggggtcccgccgaggcctccggaggggacggtcgtagggaggttcgggtcgtttggggttacagttaaggaagcggaagtccccgttaagtggggtcggggacaaacgaacgaacgtaccgggcccgtacgttaccgtaagggtaaaaagggcctaaaggtactttaccgaacggtcccttacgtacgaaaggacgtaagttacggtaaacttaaaccccgaaaaaggtcctaacgttacccgtaccctttaaacttcccgttacggacctaaccgtaaagtcggaaacggaccgaacggtacccgtaagggaaggaaaacgggtaccggtaacgggaacccgtaccggtaaccggtacccggtttaggtttaacctttacgtttacggttttacttttaacgtttacgttaccgttagggtaacggttaaggtttacggtttaggttttaaac

SEQ ID NO: 426181 - DNA, 616 bp, Homo sapiens
  misc_feature: GZ8MTXP02F10IR.25.4.A04.1.454.CMB.2.raw
  modified_base (282)..(282): a, c, t, g, unknown or other
  modified_base (365)..(365): a, c, t, g, unknown or other
  modified_base (420)..(420): a, c, t, g, unknown or other
  modified_base (434)..(434): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgcatctgttggagacagaatcagcatcacgttcggccgggcagtcgagggctattagactaattattagcctggtaatacaaacaagaaaccgagggtanagttacctaagtcctcctagtatactatgcttcgccctacaacggttaccaccgtccgacggggtccctattccgtcggttcncggtccggacaggtagaagtccgtaggggactaggtatcactctactaacttacncacgcgacgtccgngaccgacgtacgtaagtagtacgttacgtacgtaacttaacgtttaacttacgtaagtaaactaaaagtaacttaaacttaccgtacccttacccttacgttaccgttacggttaccgggaacggtaacgggtaacgtaagggtacgtaaacgtaacgtaacgtaaacgtacgtacggtacg

SEQ ID NO: 426182 - DNA, 566 bp, Homo sapiens
  misc_feature: GZ8MTXP02GFW9N.25.4.A04.1.454.CMB.2.raw
  modified_base (348)..(348): a, c, t, g, unknown or other
  modified_base (358)..(358): a, c, t, g, unknown or other
  modified_base (371)..(371): a, c, t, g, unknown or other
  modified_base (394)..(394): a, c, t, g, unknown or other
  modified_base (407)..(407): a, c, t, g, unknown or other
  modified_base (427)..(427): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttgagacagaatcagcatcacgttggaccgggcgagtcgagggctagttagctaattattagcctagtatacaaacagaaaccgagggatacgttcctaagctcctgatctatgcttcgacctcaacgttacaccgtcgacgggtcccattcgtcgttcnggtcgcagtnaattcgagggacngtacgttacactcgtactatacncaacgcacggccngaccacggcctagtaaagtnttagggtttacaactttaaactttattactaacgtaaactaaagttactaactactccgtccctacttacgttacgttacgggacggtaacggtaaccgtaagggtacggactaacgtaccgaaacggtctacggtacg

SEQ ID NO: 426183 - DNA, 616 bp, Homo sapiens
  misc_feature: GZ8MTXP02FYAIY.25.4.A04.1.454.CMB.2.raw
  modified_base (218)..(218): a, c, t, g, unknown or other
  modified_base (265)..(265): a, c, t, g, unknown or other
  modified_base (333)..(333): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccggngagtcgagggcattagactaattattagctgtatacaacagaaaccnggagagttcctaagctcctgatctatgctcgcctcacgttacaccgtcgacgggtccagtctcgttcngcgcagtgaatcgtgggactagagttcactctacactatcgagcacgcctgaccgtacgaccttagaaagtagttacggttactaaccttaaacgtttatttaacccgttaagttaaaccggtaaaaagtttaacttaaaaccgttaaccttcccggtaccccctttacgttacccgttaaccgggtttacccggggaaccggtaacggggtaacccggtaaaaggggttacggtaaacggtaaccgttaaaccgaaaaccggttaaaccgtgggttaaccgg

SEQ ID NO: 426184 - DNA, 610 bp, Homo sapiens
  misc_feature: GZ8MTXP02FZVJN.25.4.A04.1.454.CMB.2.raw
  modified_base (179)..(179): a, c, t, g, unknown or other
  modified_base (262)..(262): a, c, t, g, unknown or other
  modified_base (284)..(284): a, c, t, g, unknown or other
  modified_base (310)..(310): a, c, t, g, unknown or other
  modified_base (373)..(373): a, c, t, g, unknown or other
  modified_base (389)..(389): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggngtccaatgtgaggtgcaactgggtggagtcgtggggggaggcttgggtacagccagggccggtccctgaccactctcctgcanagcttccggactcacctttggngagcatgctatcgacctggggtcccnccagggcctccgaggggagggtctgggagtgggcttggggttcagttagaagcgaagcctagngggtggggacaacganatcgccgcgtcagtaaaagggcagagttcagcctactcaagagataaacttaccaaaagtcatccgctaagtctagcaacatgaagcaagcctaggaacggaacggacggtaacggggacttacggaacggtccgttaggttaacttaccgtttaggttttacttaacgttttaaccctcgttacgggtaagtacggtttaacggttacggtttttaaacg

SEQ ID NO: 426185 - DNA, 534 bp, Homo sapiens
  misc_feature: GZ8MTXP02GUU3L.25.4.A04.1.454.CMB.2.raw
  modified_base (396)..(396): a, c, t, g, unknown or other
  modified_base (448)..(448): a, c, t, g, unknown or other
  modified_base (470)..(470): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttgggtacagccaggcccggtccctgacactctcctgcacagcttccggactcacctttggtgagcatgctatgacctgggtccgcaggctccgaggggaaggtctggagtggcttgggtcagttagagcgaagcccctatggtggggacaacacaatcgccgcgtctagtaaaagcagnttcagcctctacaagagatgataccaaaagtcatcgctatctgcacatgacncacgcgagagagacggacgacncgacgtcgtagttacttacgttagtttacttaattactcgtacgagtagttagtttagtttaac

SEQ ID NO: 426186 - DNA, 657 bp, Homo sapiens
  misc_feature: GZ8MTXP02I0FSW.25.4.A04.1.454.CMB.2.raw
  modified_base (288)..(288): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaagtggtggagtcggtgggggagtcgttggtacagccgaggcccggtcctgactctctcctgcacagtccttccggactcgtacgtttggngagcatgctagtcggaccgtcgggtccgacgacggcctaccggaaggggtaacggttcgtgggaggttcgggtcgtttaggggttactaagttaaggaacgtacggaacgtccgtaggtggggacggaacaaacgacgtacgtccgaccggtacgttacgtaaaggtaaaacgcgtaacgtacttacgaccgtacctctaacgaaagtagtaacgtacgtaacttaaacccgaaaagtcctaacgttccgtaccttacgtctacgaccacgtaagcggaactcgacgcgtaaggacgacggacgagactcgacgtacgttattacttacttgttaactttacgtacgtctaggtattaggttatttaag

SEQ ID NO: 426187 - DNA, 613 bp, Homo sapiens
  misc_feature: GZ8MTXP02J09FT.25.4.A04.1.454.CMB.2.raw
  modified_base (279)..(279): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccaggccggtccctgaccactctcctgcacagcttccggactcacctttggngagcatgctatcgaccgtgggtccgccgaggcctccgaggggaggtcgtgggacgtggtcgttgggttcagttagaagtcgaagcctagtgggtggggacaacgacataccgccgcgtctagtaaaaggcaagacttcagccctactacgaagagatagaacttaccaaaagccaagtccgaccctatccgtagcaacatacggacggactaacggccctagggaaaggaaacggcggtaacgggacctacggaaacggtcccggtagttaactttaccgtaggttttccctttaagttaaccctcgttaggagttaacggtttaggtttaagg

SEQ ID NO: 426188 - DNA, 674 bp, Homo sapiens
  misc_feature: GZ8MTXP02HR9CK.25.4.A04.1.454.CMB.2.raw
  modified_base (249)..(249): a, c, t, g, unknown or other
  modified_base (278)..(278): a, c, t, g, unknown or other
  modified_base (303)..(303): a, c, t, g, unknown or other
  modified_base (381)..(381): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaacatggagtttggcttaactgttcttttccttgttgcttagttttaaaaggtgtccaatgtgaggtgcaacgtggtggagtcgtgggggagtcttggacagccaggcccggtcctgacactcncctgcacagcttccgactcaccgtttggnagcatgctatcgaccgtcggtcccncgaggtcctaccggaggggaaggtctgggagtggcgtttgggttacagttaagagcgaagtccccgtaagttcggggngggaccaaaacgacgaaacgttccggccgtcgttactaagggtaaaaacggccaaaggttacttcgaacgtcccttacaccgaaaggagtattacgtaaactttaacccgaaaaaggccttaaaggtccccgtacccttaaattcccgttagaccccttaacggtaacgtacgacgacgacgtacgacggaacgaacggacggacgtacgtacgtacgtacgttacgttacgttactttacgtttactttaacgttacgttacgtacgtagtacgtttacgtttagtttaacg

SEQ ID NO: 426189 - DNA, 543 bp, Homo sapiens
  misc_feature: GZ8MTXP02I5T99.25.4.A04.1.454.CMB.2.raw
  modified_base (280)..(280): a, c, t, g, unknown or other
  modified_base (304)..(304): a, c, t, g, unknown or other
  modified_base (362)..(362): a, c, t, g, unknown or other
  modified_base (527)..(527): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggcccggtccctgacactctcctgcacacgcttccggactcacctttggnagcatgctatcgacctgggtcccnccgaggctccgaggggaggtctggagtggcttgggttcagttagagcgaagccctagnggggtaggggcaacacaagtccgccgcgtactaggtaaaaggcaagtattcagtccctactcgaaagagatgaattacccgaaaagcaactcgcctagcctgcactagcgagcacgccagaaggagcgtaggactgacgtcgtgtaacttctgttcttaatctcngagtagtagtgtttaa

SEQ ID NO: 426190 - DNA, 762 bp, Homo sapiens
  misc_feature: GZ8MTXP02JB6LF.25.4.A04.1.454.CMB.2.raw
  modified_base (276)..(276): a, c, t, g, unknown or other
  modified_base (304)..(304): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaacgtgggtggagtcggtggggggagtcgttgggtacaggcccgagggcccggtccctagacctacttcctcctgcacgngtccttcccggactccgtaccgtttggngagctatgactacgtacgacccggtcgggtcccgaccggacggtcctaccggagggggtaacggtcgtagggtaggttcgggttacgtttaggggttactaaggttaacggaaaggtaccgtaaaccgggtccgttaaggggttcggggacggggaaccaaaaccggtaactaacggtacccggccccgggtacgttacgtaaaggggtaaaaacgcctaaggtacttacgacgtacctacagaaagtaatctacgaacttaacgaaaatctaacgccttacctaactctacgaccagtagacgacgcgtaacgcggtaagaacggaacgacgggttaaaccgccttaccggaaacgggttccctttaggttaaacccgtttttacgtttacgtttaacgtttacgttaaccgtacggttaaggttaaacgggtttacggtttaaccggtttttaaag

SEQ ID NO: 426191 - DNA, 798 bp, Homo sapiens
  misc_feature: GZ8MTXP02F9SDO.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggagtcttggtacagccaggcccggtcctgacactctcctgcacagccttcccggactctaccgtttggtgagcatgctagtcggtacccgtcggggtccccgaccgacggtccgtacccggaagggggtaacggggttcgtaggggtaggttcgggtacgttttcggggtttactaaaggtttaacggaaacggtaccggaaaccggtacccgtaagggttcggggtacgggggaaccaaaacccgtaaacgtaacgtacccggtaccccggtacggttaccgtaaagggtaaaaaacggcgtaaaggtacttaccgacggtcccttacgtaccgaaagacgtaacttagtaaaccttaaccgaaaaacgctaaacgtaccgtacccttaacgttccttacggacctaaccaagttacggaacgtccgtaaacggtcccgtagggaaaaggaacgggaaccgggtaaacggaccgttaccggtaaaccgggtcccggtttaaggtttaaacctttaaccggtttagtttaacgttttacttaacgtttccgtaggtaacgtttaggtttaacgtttttaagg

SEQ ID NO: 426192 - DNA, 640 bp, Homo sapiens
  misc_feature: GZ8MTXP02F2NO5.25.4.A04.1.454.CMB.2.raw
  modified_base (194)..(194): a, c, t, g, unknown or other
  modified_base (219)..(219): a, c, t, g, unknown or other
  modified_base (475)..(475): a, c, t, g, unknown or other
  modified_base (620)..(620): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgttgganacagatcagcatcacttggccgggngaggtcgagggctagttagactaattattacgccgtaggtactacaaacgaaggaaaaccgagggtaagtacgtttacctaaacggtcttacccgtagtacttactagtcgtacctcgtaccctaccgtaaccgtttacacccgttacggtaccggggtaccctaagttccgttaccggttacgacggtccggactaaggtacgaacgttcgggacgggaaactacgttacgttaccacctacttacctacttacnccgaagacctacggccctagaccgtacgaccgttaggaaacttgttacgtacgtaaacttactttaacgtacgtaaagttaaccaaaatttactaactacgtcctacctctacgtacgttcggacggacgtaacgtaagacgganacgtaacgaaacgcgtagcg

SEQ ID NO: 426193 - DNA, 657 bp, Homo sapiens
  misc_feature: GZ8MTXP02GLAGF.25.4.A04.1.454.CMB.2.raw
  modified_base (274)..(274): a, c, t, g, unknown or other
  modified_base (297)..(297): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaggtgtcaatgtgaggtgcaatggtggagtcgtgggggagcttggtacagccaggccggtccctgacactctcctgcacagcttccggactcacctttggnagcatgctagtgacctgggtccnccagggctccgaggggaaggtcgtggagtggtcgtttggggttcagttaggaagtcgaacgtcctagtgggtacggggacaacacataccggccgtcgttacgtaaggtaaaagggcaaggtactttacgacgtacccttacgtaccgaaagtaagtacgttaggtaaacctttaacccgaaaaaaggtccgtaaactcccggtacccttaacttccgtacgacctaacagttagacgacgaacgccgtaggaacggaagcgggaaggaccgtacgacgggtacccgttaggttaacctttacgtttagtttaacccgtttatttaaccttcgtaagtaggttacgtttaaggttttagg

SEQ ID NO: 426194 - DNA, 641 bp, Homo sapiens
  misc_feature: GZ8MTXP02I92UC.25.4.A04.1.454.CMB.2.raw
  modified_base (195)..(195): a, c, t, g, unknown or other
  modified_base (220)..(220): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctcctgtctgcatctggtgganacagaatcagcatcacttggccggngagtcgagggcagttagctaatttagttagcctaggtataccaaacgaagaaaccgaggggatacgttacctaaggctcctagacttctagtcgctcgcctaccacgttacacccgtcgacgggtcccctagttccgtacggttcagggcgtcgtagtagaagtcgtacgggatagtacgttacctactctacaacttacgacacgacacgtcccgtgaccgtaacgtccgtaagaacggttgttacggtaactaacgttaaacttattaacgtaacgtaaaacgtaaaagtaacgttaaactaccgttacccgttaccccttacgttaccgggttaccggttaccggggaaccgggtaacgggtaaaccggtaagggtacggtaacgtaaaccgtaacggtaaaacgtacgtcggtacgg

SEQ ID NO: 426195 - DNA, 543 bp, Homo sapiens
  misc_feature: GZ8MTXP02H0DQJ.25.4.A04.1.454.CMB.2.raw
  modified_base (276)..(276): a, c, t, g, unknown or other
  modified_base (518)..(518): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtggggggaggcttggtacagccagggccggtccctgacactctcctgcacagcttccggactcacctttggnagcatgctatgaccgtgggtccgccaggctccgaggggaaggtctggagtggcgttgggtcattagagcgaagcctatggggtggggcaaaacacaagtaccgccggtcgtcttaggaaaagggcaaggattcagcctctacaagagatagaacttaccaaaagctagtcacctatctgacacatgagcagcctgacgaagcgaggactcgagccgtgtaacttcttagttcttattaactntagagtagtagtggtttaactttaa

SEQ ID NO: 426196 - DNA, 692 bp, Homo sapiens
  misc_feature: GZ8MTXP02GY5NV.25.4.A04.1.454.CMB.2.raw
  modified_base (266)..(266): a, c, t, g, unknown or other
  modified_base (290)..(290): a, c, t, g, unknown or other
  modified_base (319)..(319): a, c, t, g, unknown or other
  modified_base (516)..(516): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgtcttagttttaaaaggtgtaccaatgtgaggtgcaacgtggtggagtcggtgggggagtcttggtacagccagggcccgtccctgaccactctcctgcacncgtccttccggactctacgttggngagtcatgactagtcgaccgtcgggtccncgacggtccgtaccggaaggggtacggtcgtagggtacggttgggttacggtttggggtactaaggttaaggaaacggacgaaccgtccgtaggtcggggtacgggaacaacgaacgacgtccgccgtacgtacgtaagtaaacgctaagtactcgacgtctacgtagaaagagtagtaacgtaactaaaccgaaanctaactccgtacttaacgtcgacgtacctaaagtagtcgacgaccgacggtacgaagggaaacgaaacggacggtaacgtaccctacggaccggttacggtttaagtttacttaccttttgttaacgtttacttaccgtacggtaaggtacggtttaacggtttaggttttaaacg

SEQ ID NO: 426197 - DNA, 586 bp, Homo sapiens
  misc_feature: GZ8MTXP02JSJ91.25.4.A04.1.454.CMB.2.raw
  modified_base (280)..(280): a, c, t, g, unknown or other
  modified_base (371)..(371): a, c, t, g, unknown or other
  modified_base (420)..(420): a, c, t, g, unknown or other
  modified_base (427)..(427): a, c, t, g, unknown or other
  modified_base (460)..(460): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttgggtacagccagggccggtccctgacactctcctgcacagcttccggactcacctttggngagcatgctagtgacctgggtccgccagggctccgaggggaggtctggagtggcgtttgggttacagttaggaagcgaagccgtagtgggnggggacaaccacatcgccgtcgtactagaaaggcagtacttcagtcctntcaaganatgaataccaaaagcatccgactctctcgcaantagacgcgacgaccgtaggaagaacggacggaacggacctaccggtacggtaccggttacgttaacgtttacgttacgtttaactttaacgtttactacgttaggtaagttacggtttaggtttag

SEQ ID NO: 426198 - DNA, 725 bp, Homo sapiens
  misc_feature: GZ8MTXP02JPL8G.25.4.A04.1.454.CMB.2.raw
  modified_base (197)..(197): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctccctgtctgctatctgttagganacagaatcagctatcacgttggccggcgagtcgagggcattagataattagttagcctaggtactacaaacgtaagaaaccgagggtatacgttacctaaacgtctaccgtagtactacttagtcgtctccgtacctaccgtaacgttacacccgtaccggacgggttcccctagttccgtaccggttcgacgggtccggagtacggtagaacgttaccgggagggtaccgtaagtaccgtttaccgtaccttacgtacctaatacgtacgacgtaccaacggtccttacgacgtacgaccgtaggaacgtagttacggttactaacttaaacgtttaacgttacgttaaacgttaaaacgttaaaacgttaacttaaacgttaccgttacccggtaccctttaacccgttacgggttaaccgttttaccgggggaaaccggggttaaccgggaaacggttaacggggtaaaacggtaacggtaaaacgtaaaccggtaaaaccggttaccggtacggttaacccggg

SEQ ID NO: 426199 - DNA, 523 bp, Homo sapiens
  misc_feature: GZ8MTXP02H776T.25.4.A04.1.454.CMB.2.raw
  modified_base (219)..(219): a, c, t, g, unknown or other
  modified_base (273)..(273): a, c, t, g, unknown or other
  modified_base (375)..(375): a, c, t, g, unknown or other
  modified_base (386)..(386): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcattggccgggnagtcgagggcaattgacaattattagcctaggtatacaaacagaaaccaggganagtccaagctctgatctatgctgccctcacgttacacctcgagggtcccatcgtcgttcacgtggcagtgaattcgagacgatacgtcacttactcacttancacgcagcccngactacgctagagtagtgtataactaacttatacgtaagtaaataaacgtaataaactcctaccgtccctactacgtacggtacggacggtaacgacgtaaggtacgaagtaactaacgtaaacgtacgtcggtacg

SEQ ID NO: 426200 - DNA, 597 bp, Homo sapiens
  misc_feature: GZ8MTXP02I8OMX.25.4.A04.1.454.CMB.2.raw
  modified_base (275)..(275): a, c, t, g, unknown or other
  modified_base (297)..(297): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggaggcttggtacagccaggccggtccctgacactctcctgcacagcttccggactcacctttggngagcatgctatgacctggtccncaggctcgagggaggtctggagtggcttgggtcagttagaagcgaaagcctagtgggtaggggacaaacgacaaacgtacgccgcgttactaaggtaaaaacggctaaggtaacttcgaacgtccctactacgaagagtatagaacttaaccaaaagcaatccgacctaatcctagaccaactagtagacgacaacggtcctaggaaggaacggacgaacgggactacgacgtccggtagttacttacgttcgtttacttaataacgtcgtagacggtagttaggttagtttaatttaac

SEQ ID NO: 426201 - DNA, 677 bp, Homo sapiens
  misc_feature: GZ8MTXP02H2264.25.4.A04.1.454.CMB.2.raw
  modified_base (283)..(283): a, c, t, g, unknown or other
  modified_base (308)..(308): a, c, t, g, unknown or other
tcagactgtacagtcacgaccggtgctcgatttagagtagtgatcaggggctgggagaggagccccagcccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtggggggaggcttggacagccgaggcccggtccctgaccactcctcctgcacagccttccggactctacctttggngagcatgctatcgaccgtgggtccnccgaggcctccgaggggtaacggtctgggagtggtcgtttgggttcaagttagaaagcgaaagcctagtgggtggggacaaacgacaaagttcccgccggtacgttacgtaaggtaaaaagggcctaaaggactttaccgacgtccctaccgtacgaaaggtaagaattaggtaactttaaccaaaagcctaacgtcgacccttatcctagcctaacagtgacgacaacgtccgagaacggaacggcggtaaggacctacgtaacggtcccggttaaggttaaacttttaccgttacgttttacttaaacgttttaactacgttacgtaacgggttacgtttaaggtttaggttttaaacttttaaacg

SEQ ID NO: 426202 - DNA, 545 bp, Homo sapiens
  misc_feature: GZ8MTXP02JFJ6J.25.4.A04.1.454.CMB.2.raw
  modified_base (342)..(342): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggcgagtcgagggcattagcaattatttagcctggtatacaacaagaaaccgagggagagttacctaagctcctgatctatgctcgcctccacgttacacctcgacgggtcccatcgtcgttcngcgcagtgaatcgtgggacagtagtccacgtctcaactatcagcacgcctgcgacgccgtagaagtatgttagactaacgttattacgtagtaactaaaagtataaactactaccgtccccttactccttacggtttccgggaacgggtacggtaacccgtaagggtcggaaactacgtaacgaaaaccgtacgtaggtacgg

SEQ ID NO: 426203 - DNA, 626 bp, Homo sapiens
  misc_feature: GZ8MTXP02GBGPH.25.4.A04.1.454.CMB.2.raw
  modified_base (192)..(192): a, c, t, g, unknown or other
  modified_base (216)..(216): a, c, t, g, unknown or other
  modified_base (273)..(273): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttganacagaatcagcatcattggccggnagtcgagggcattagctaagttatttagcctggtatacaaacgagaaaccgaggganacgttctaagctctgatctatgctcgcctcacgttacaccgtcgacgggtcccatccgttacggttcaggcgactaggttacgaagtcgtaggggactaacgtagtttccaactctacacctatccagacaacgcctcgacacgaccgtagtaagtaagtggttacgtactaaacctttaacgtttaattaacggttaaaccgtaaaacgttaaagttaaaacgttaaccgttaccgttaaccccttccctttaccgttaaccggtttaccgggtaccggggtaacgggtaaccggtaaacgggtaacggtaacggaacgtaacgtaaaaccggtaaacgttaggttaacggg

SEQ ID NO: 426204 - DNA, 675 bp, Homo sapiens
  misc_feature: GZ8MTXP02JDA73.25.4.A04.1.454.CMB.2.raw
  modified_base (274)..(274): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaactggtggagtcgtgggggagtcttggacagccaggccggtccctgacactctctgcacagccttccggactcactttggngagcatgctagtcgaccgtgggtccccgcgacgggcctaccggaagggggtaagggtcgtgggtaggtgggtccgtttggggttacaagtttaaggaaaggcgaaaggtcctaaggtcggggtcggggaccaaaactaacgaaactacccggcccggtacggttaactaagggtaaaaacggctaaaggtacttacacgtccctactacgaaagagtatacgacttaccaaaagctacgtccgtacctagttcacgacactagtagacgcgacgtctaggaagaagacggacggactcgacggtaccgttgttaaacgtttacgttacgttttacctttacgttaaccttacggtaggtaaacggttagtttaacgggtttaggttttaattttaaaaccg

SEQ ID NO: 426205 - DNA, 576 bp, Homo sapiens
  misc_feature: GZ8MTXP02GEQVA.25.4.A04.1.454.CMB.2.raw
  modified_base (301)..(301): a, c, t, g, unknown or other
  modified_base (490)..(490): a, c, t, g, unknown or other
  modified_base (544)..(544): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaacgtggtggagtcgtgggggagcttggtacagccaggccgtccctgacactctcctgcacagcttccggactcaccttggtgagcatgctatcgacctgggtcccnccgaggcctaccgaggggaaggtcgtagggagtcggtacgtttgggttcaagttagaaaggcgaaacgccgtaagtggggtacggggacaaacgaacgagtaccgccgcgtacgtagtaaaaacggcaagtacttcacgcctctacaaagaggatagacttaaccgaaaagctaaatccgacctattcnactacagtgagacagcctagagaagcgagactcgacgacgtgtaacttacgttnttaacttatacttctagagtagtactttaagg

SEQ ID NO: 426206 - DNA, 677 bp, Homo sapiens
  misc_feature: GZ8MTXP02GDJDX.25.4.A04.1.454.CMB.2.raw
  modified_base (256)..(256): a, c, t, g, unknown or other
  modified_base (279)..(279): a, c, t, g, unknown or other
  modified_base (305)..(305): a, c, t, g, unknown or other
tcagactgtacagtcacgaccggtgctcgatttagagtagtgatcagggggctggggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtcgtgggggaggcttggtacagccaggccggtccctgacactctcctgcacngcttccggactctaccgtttggngagcatgctatcgaccgtgggtcccnccgaggcctaccggaggggtacgggtcgtgggaggtcgggtcgtttggggttctaagtttaaggaacggcgaaaggtccgttaggtggggtacggggacaaacgacaaacgttccggccggtcgtacgtaaggtaaaacgggccaaggtcttacgacgcccttacgtacgaaaggagtatagtaacttacgaaaagcctaagtccgtacctatctcgacaacagtacgacgacacggtacctaggaaggaacggacgaacgggtacctacggacggttaccggttagttactttaccgttacgttttactttaaacgttccgttacggttaggtaaggttacggtttaggtttacggtttaaattttaaacc

SEQ ID NO: 426207 - DNA, 586 bp, Homo sapiens
  misc_feature: GZ8MTXP02HL6OQ.25.4.A04.1.454.CMB.2.raw
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttagttttaaaaggtgtccaatgtgaggtgcaactggtggagtcgtgggggagcttggtacagccaggccgtcctgacactctcctgcacagccttccggactctaccgtttggtgagcatgctatcgaccgtgggtccgccgaggcctccgaggggaggtctggagtggctttggggtctagttagaagcgaagtctagtgggtacggacaacacaagtaccgccggtacgttacgtagtaaaacggcagtacttcgaacgtccttcacgaagtagagtagtaacttacgaaaagcactccgtacctatctagcacgtacgtagacgacacgccgaggaagacggacgacggtactcgacgtccgttagttacttacgttcttacttataaccgtgtagtagtagttagttagtttactttaac

SEQ ID NO: 426208 - DNA, 665 bp, Homo sapiens
  misc_feature: GZ8MTXP02JKKSQ.25.4.A04.1.454.CMB.2.raw
  modified_base (283)..(283): a, c, t, g, unknown or other
  modified_base (294)..(294): a, c, t, g, unknown or other
  modified_base (309)..(309): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgctaacgtggtggagtcgtgggggagcttggtacagccgagggcccgtcctgacctactctcctgcacagtctccggactctaccgtttggngagcatgctancgaccgtgggtaccnccgaggcctccggaaggggtacggttcgtagggacgttgggtccgtttaggggttcaagtttaacggaacgcgtaaacgtccgttaagtggggtacggggaccaaacgtacaacgttaccgcgtacgtcgtaagtaaaacgcagtactcgacgcctacgtacaagacgtattacgacttaacaaaacgcctaacgtaccgtacccttatcttacggacctaacgtacgtacgaccgcgtaaccggtcctaagggaacggtaacgacgaaggtaccttagacggtcccgttagttaacttacgtttctacctttaatcgtcttaaggacttagtttaacggttatttactttaaacc

SEQ ID NO: 426209 - DNA, 537 bp, Homo sapiens
  misc_feature: GZ8MTXP02IV4QH.25.4.A04.1.454.CMB.2.raw
  modified_base (220)..(220): a, c, t, g, unknown or other
  modified_base (270)..(270): a, c, t, g, unknown or other
  modified_base (303)..(303): a, c, t, g, unknown or other
  modified_base (307)..(307): a, c, t, g, unknown or other
  modified_base (347)..(347): a, c, t, g, unknown or other
  modified_base (353)..(353): a, c, t, g, unknown or other
  modified_base (420)..(420): a, c, t, g, unknown or other
  modified_base (516)..(516): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatactccctgtctgcatctgttggagacagaatcagcatcacgttgccgggngagtcagggcattagactaattattagcctggtatacaaacagaaaaccngggaatagttacctaagcctcctagtatctatnctcncctccaacgttacacctcgacgggtcccagtctcggttcnggccgnacgtgaattcgaggggacagtacgttcactctacactatccaagcagctgaccacgtccgagaaagnttagtagtactaaacctttagttactagtaactaaaattataaactaactctcccctatacgttacgtttcggacggtacggaactaagggagaanacgtaacaaacgtactggtcg

SEQ ID NO: 426210 - DNA, 724 bp, Homo sapiens
  misc_feature: GZ8MTXP02GHDNL.25.4.A04.1.454.CMB.2.raw
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactgggtggagtcgtgggggagcttggtacagccgaggcccggtcctgacactctcctgcacagcttccggactctaccgttggtgagcatgactagtcgaccgtgggtcccgccgaggcctaccggaaggggtaacgggtcgtggggtaggtcgggtcgtttggggttacaagtttaaggaaaggtcggaaaccgtccgtaggtggggtacggggacaaaccgaactacgtaccgcccggtacgttaccgtaagggtaaaaacggccaaaggtacttacgaacgtccctactaacgaaagtaagtattacggtaaacttaaccgaaaaacgtctaacgtacccggtaccttaatccgtagacctaacaacgtgaacgaccgacgccctaagaacggaaacggtaccggtaaacgggacctaacggaacggttacccgttaagtttaacgtttaacggtttacgttttaaccgtttaaactttacccgtacgtaaggtaacggttaacggttttaaggttttaaacgg

SEQ ID NO: 426211 - DNA, 704 bp, Homo sapiens
  misc_feature: GZ8MTXP02JMKRB.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatccctcctgtctgcatctgtggagacagaatcagcatcacttggccgggcagtcgagggctattagctaaatttatttacgcctggtactacaaaacagaaaaccgaggggaactagtttaccctaaggccttacccgtagtattctatgctcgcctacacgttacaccgtacgtacgggtccctagttccgttacggttacacgggtccggtacgtaggttacgaagttccggtaggggaactacgtacgtttaccaactcctactaacgttaacctacgacgctacgtaccgtacgaccgtacggtaacgtaaggtaacgttacggtttacgttaacgtaaacctttaaacgtttacgttaaacgtaacgttaaaacgttaaaacttaacgttaacgttaacccgttacccgttaccctttaccgttaccggtttaacccgggttaccggggaaccgggtaaacggtaaccggtaaacggggtacgtaaaccggttaaacgtaaaccgaaaccggttaacggttacggtaccg

SEQ ID NO: 426212 - DNA, 658 bp, Homo sapiens
  misc_feature: GZ8MTXP02IPRTU.25.4.A04.1.454.CMB.2.raw
  modified_base (507)..(507): a, c, t, g, unknown or other
  modified_base (524)..(524): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttagttttaaaaggtgtccaatgtgaggtgcaactgggtggagtcgtgggggagcttggtacagccaggcccggtcctgacactctcctgcacagtcttccggactcaccgtttggtgagcatgctagtcgacctgggtcccgccagggctaccggaggggaagggtctgggagtgggtctttggggttcaagtttagaagcgtaacgccgtagtgggtcggggacaaacgactagtaccggcccgacgttactaggtaaaaacgggcagtaacttccacgtaccctactcgaaagagactagtaacgttaaccaaaagtcaacgtaccgccttacttacgnggaccactaatggacgnaacggtccgtaggaacggaagtacggaacgggacctacgaaacggtcccggtttagttaaaccgtttcgtttacgtttaacgtttaaaactttccttacgtaaggttacgggtaagtttacggtttttaaaggg

SEQ ID NO: 426213 - DNA, 634 bp, Homo sapiens
  misc_feature: GZ8MTXP02JXUYK.25.4.A04.1.454.CMB.2.raw
  modified_base (277)..(277): a, c, t, g, unknown or other
  modified_base (301)..(301): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaggtgtccaatgtgaggtgcaactggtggagtcgtgggggaggcttggtacagccaggcccggtccctgacactctcctgcacagcttccggactcacctttggngagcatgctatgaccgtgggtccncgagcctccgagggaggtctggagtggcttgggtcagttagagcgaagcccctagtgggtcgggacaacgacaagtccggccgtcgtacgtagtaaaacgggcctaagtacttaccgacgtccctacgtacgaaaggagatagtaacttaacccgaaaagcctaatcccgtaccttaatccgtgacccaacgtagtacgacgaccgacggtccctagggaaacggaacgacggtacgggacctacgaccggtaccgttaggttaactttacccgttagtttacctttaattccttacggtaggtaagtacggtttaacgtttaggttttaaac

SEQ ID NO: 426214 - DNA, 818 bp, Homo sapiens
  misc_feature: GZ8MTXP02G7C4C.25.4.A04.1.454.CMB.2.raw
  modified_base (261)..(261): a, c, t, g, unknown or other
  modified_base (282)..(282): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtccaatgtgaggtgcaacgtggtggagtcgtgggggagcttggtacagccgaggcccggtccctgacactctcctgcacngccttccggctcacctttggngagcatgctatcgaccgtcgggtcccgaccgacgggtcctacccggaaggggaacgggttcgtgggtaggttgggtccggttttggggttactaagtttaacggaaaggtcgtaaacggcccttaaggtggggtacggggacaaaaccgaacgtaagtaccggcccggtacgtacgtaagggtaaaaacgggctaaggtacttcaacggtccctacgtaacgaaagagtacgttaggtaaacttaaacccgaaaaaggcctaaacgttccgtaaccctttaacttccgtacgggaccaaaccaacgttaggaaacgtacccggtaaacgtcccgtaaagggaagggaaaacgggtaacggaacccggggtaaccttacccgggaaacgggttacccccggttttagggtttaaaaccgtttttaaccccttttaggttttaaaccccgtttttaaagttttaaacccccgtttacggttaaacgggtttaaaacggggttttaaaacggtttaaacggggtttttttaaaacgggg

SEQ ID NO: 426215 - DNA, 713 bp, Homo sapiens
  misc_feature: GZ8MTXP02IPD3U.25.4.A04.1.454.CMB.2.raw
  modified_base (287)..(287): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttgttttaaaaggtgtcaatgtgaggtgcaacgtggtggagtcgtggggggagcgttggtacagccgaggcccggtcctgaccactctcctgcacagccttccggactcctaccgtttggngagctatgcttagtcggtacccgtcggggtccccgccgacgggccgtacccggaagggggtaacggggtcgtaggggtacgggtttgggtcgttttggggttactaaagtttaaggaaacgggtaccggaaaccggttccccgttaagggttcgggggttaacgggggaaccctaaaaccgaaaccgtaacggttacccgggaccccggttaccggttaaccgttaaagggtaaaaacgggactaacggtacttacgacgtcctactacgaaagagtatagtacttaacgaaaagtcactaccgtactatctcgacacatgacgcgacgacgtagacgaacggacggaggacctacgacgtcgttacgttaactttacgtttacgttaacgtttacttacgttctaggtagtagtttagtttaacg

SEQ ID NO: 426216 - DNA, 705 bp, Homo sapiens
  misc_feature: GZ8MTXP02JAC1Q.25.4.A04.1.454.CMB.2.raw
  modified_base (297)..(297): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagtttaaaaggtgtccaatgtgaggtgcaacgtggtggaggtcggtgggggaggcgttgggtacaggccgacgggcccggtccctgaccactcctcctgcacagtccttcccggactctaccgtttggngagctatgctagtcgaccgtcgggtcccgccgaggccgtaccggaaggggtaacggtcgtggggtaggttgggtcgtttaggggttactaagttaaggaacggtacgaacgtccgtaaggtcggggtacggggactaaacgaacgtacgtaccgccggtacgtacgtaaggtaaaacggctaagtacttcgaacgtccctactacgaaagagtagtagtaacttaaaccgaaaagcaactccgtactaactctcgaccaatacgtacgacgacgtacggacgtaagggaacggtaacgacgggaaacgtaccgtacggtaaacggttccgttaagtttaccgtttacgttacgtttaacgtttaacgttacgttacgtaaggttaaggttacggttttaacgtttaag

SEQ ID NO: 426217 - DNA, 564 bp, Homo sapiens
  misc_feature: GZ8MTXP02FF3DH.25.4.A04.1.454.CMB.2.raw
  modified_base (252)..(252): a, c, t, g, unknown or other
  modified_base (295)..(295): a, c, t, g, unknown or other
tcagactgtacagtcacgaccggtgctcgatttagagtagtgatcaggggctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaactggtggagtctgggggagcttggtacagccaggcccggtcctgacactctcctgcacngcttccggatcacctttggtgagcatgctatgacctgggtccnccaggctccgaggggaggtctggagtggcttgggtcagttagaagcgaaagcctagtgggtggggcaaacacaaacgtcgccgcgtactagtaaaaacggcaaggacttcaacgcctctacaagagaatagattaccaaaaagcaacgtcacctatctgacacaatgacgcacgcctagaagaaagcgtaaggactacgagacccgtagtaacttacgttcgtttacttaactaactcttagagtagttacgttaggttactttaaacg

SEQ ID NO: 426218 - DNA, 608 bp, Homo sapiens
  misc_feature: GZ8MTXP02JV8S4.25.4.A04.1.454.CMB.2.raw
  modified_base (260)..(260): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtgggggagcgttggtacagccaggccggtccctgacactctcctgcacngcttccggactctaccttggtgagcatgctagtcgaccgtgggtcccgccgacggccgtccgaaggggagggtcgtggtaggtgggtcgtttggggttacagttaagaagccgaagcccctagtcgggtggggacaacacaagtaccgccgacgtacgtagtaaaagcaagacttcagtccctgtacaagtagatgaacttaccaaaagctaataccgtaccttatctgacacagtagacgacgacgtaccgaggaacgaagccggaggaccgtcgacggtccgttagttacttacgttcgtttactttaacgttactacgtacgagtaggtttagttacggtttaaa

SEQ ID NO: 426219 - DNA, 686 bp, Homo sapiens
  misc_feature: GZ8MTXP02FRQMS.25.4.A04.1.454.CMB.2.raw
  modified_base (285)..(285): a, c, t, g, unknown or other
  modified_base (310)..(310): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgtcttagttttaaaaggtgtaccaatgtgaggtgcaacgtggtggagtcgtgggggaggcttggtacagccaggccgtccctgacactctcctgcacagtccttccggactctacctttggngagcatgctatcgaccgtcggtccnccgaggcctaccggaggggaaggtcgtggagtggtcgttgggtctagttagagcgagcccctagtgggtgggacaaacgaacaacgtccggccgtacggtacgtaacggtaaaaacgggctaaaggtaacttccgaacgtccctactacgaaagagtaagtcgtaaacttaacccgaaaagactaccgttaccgtaccttatccgtacgacctaacgtagtaacggacgaccgacggtaccgtaaggaaacgggaacggtaacggaacggtaccgtaccggtacgttaccggttactttaacgtttaccgtttacgtttacttaacgttaccgttacgttacggttaaggttaacggtttacggtttaagtttaac

SEQ ID NO: 426220 - DNA, 576 bp, Homo sapiens
  misc_feature: GZ8MTXP02FKA36.25.4.A04.1.454.CMB.2.raw
  modified_base (221)..(221): a, c, t, g, unknown or other
  modified_base (399)..(399): a, c, t, g, unknown or other
  modified_base (413)..(413): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacgttggccgggngagtcgagggcattagctaattattagcctaggtatacaaacagaaaccgagggagagttacctaagctcctgatctatgctcgccctcacgttacaccctcgacggggtccagttcgtcggttcaggtccgacacgtgtaacttcgtagggactagtagttccactctctaacttanacgacgcacgtccngactacgccgtagaagtgttagttacgaacttaactttagttaacgtacgtaaactaaaagttaataaacttactaccgtcccttactcctaacggtttcgggaaccggtaggggaaccgtaagggtacggtaagtacgtaacgaaacgtaacgtaggtaccg

SEQ ID NO: 426221 - DNA, 793 bp, Homo sapiens
  misc_feature: GZ8MTXP02G09WV.25.4.A04.1.454.CMB.2.raw
  modified_base (246)..(246): a, c, t, g, unknown or other
  modified_base (257)..(257): a, c, t, g, unknown or other
  modified_base (279)..(279): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggaggcttggtacagccgaggcccggtccctgacnctctcctgcanagcttccggactcacctttggngagcatgctatcgaccgtcgggtcccgccgacggcctacccggaggggaacgggttcctaggggtaggttggtcgttttggggttactaaggtttaaggaacggacggtaaaaggtcccccgttaaggttcggggttacgggggaacctaaaaccgaaaccgtaaacgttaccccgggccccggtaccggttaccgtaaaggtttaaaaaacggggctaacgggtaactttaccgaacggtccccttacgtaacgaaaggaacggtaattacggtaactttaaaccccgaaaaagtacctaacgttacccgtacccttaacttccgttacggacccacttaagtacggtaacgccgaaacgccccgtaaggggaaggaaaacgggcccggaaaggggtaacccttccgaaagggttccccggttagtttaacgttaaccctttggttttaacctttaacggtttacttaccggttagtaacggtttagtttaacgggtttaaggtttttaaacc

SEQ ID NO: 426222 - DNA, 610 bp, Homo sapiens
  misc_feature: GZ8MTXP02JWWO8.25.4.A04.1.454.CMB.2.raw
  modified_base (227)..(227): a, c, t, g, unknown or other
  modified_base (376)..(376): a, c, t, g, unknown or other
  modified_base (400)..(400): a, c, t, g, unknown or other
  modified_base (411)..(411): a, c, t, g, unknown or other
  modified_base (418)..(418): a, c, t, g, unknown or other
  modified_base (429)..(429): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctatggctcccagataccagatgtgacgtccagatcgacccagtctccatccctccctgtctgctatcgtgttggagacagaatcagctatctacgttggccgggngagtcgagggctattagactaattagttacgcctaggtatacaaacgaagaaaccgagggatacgttacctagtcctctagtactactagtcgtctcgtcctaccgtacgttaccaccgtccggacggggtccctagttcgtcggttcncggcgcagtagaagtcgagggacngtactcactcnctactancaagcagtccngaccgagtccgtaggagtagttcggttacaacttacttacgttaactaacgttaaactaaaattactaacttaccgtaccctccctacgttaccgttaccggttacggggaccggggtaacggaaccggtaaggggttacggaaacgttaacggaaacgtaaaaccggtagtacggtccgg

SEQ ID NO: 426223 - DNA, 667 bp, Homo sapiens
  misc_feature: GZ8MTXP02HT2EI.25.4.A04.1.454.CMB.2.raw
  modified_base (201)..(201): a, c, t, g, unknown or other
  modified_base (220)..(220): a, c, t, g, unknown or other
  modified_base (356)..(356): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatnagcatcacgttggccgggngagtcgagggcattagactaatttattagccttaggtatacaaacgaagaaaaccgaggggaagtagtttacctaagctcctgactctatgctcgcctccagtttaccacctcgacgggtcccatcgtccggttancggtcgggacagtacgaattccggaggggactagggtacttaccacttcactaacttactccgacggacacgttcccgtcgacgtaaccgtaccgttagggtaaaagtgtttcgggttacgtaaccttaaacctttaaggttaacctttaaagggtaaaccgttaaaaaagtttaaaagtttaaaacccttacggtttaacccgttcccccttacgttacccggtttaaaccggtttcggggaccggggttaacgggggaccgtaaaggggttaacggacgtaaacgtaacgaaaccgttacgtggtacgg

SEQ ID NO: 426224 - DNA, 591 bp, Homo sapiens
  misc_feature: GZ8MTXP02IKUN0.25.4.A04.1.454.CMB.2.raw
  modified_base (428)..(428): a, c, t, g, unknown or other
  modified_base (456)..(456): a, c, t, g, unknown or other
  modified_base (461)..(461): a, c, t, g, unknown or other
  modified_base (464)..(464): a, c, t, g, unknown or other
tcagactgtacagtcacgaccggtgctcgatttagagtagtgatcaggggctgggagaggagccccagccgtgagattcccaggagtctccacttggtgatcagcactgaacacagacccaccaaccatggagtttgggcttaactgtcttttccttgttgctgttttaaaaggtgtccaatgtgaggtgcaactggtggagtcgtggggggaggcttggacagccaggccggtccctgacactctcctgcacagcttccggactcacctttgtgagcatgactatgacctgggtccgccaggctccgaaggggaaggtctggagtggcttgggttcataggaagcgaaagctagtgggtggggacaaacacaaataccgccggtagtactaggtaaaaagccagaattcaagcctactcaaagaganagattaccaaaagcaatcgcctatactncacanagngacacgacgagaaggaagcggaacggactacgacgtacggttagtaacgtttacgttacgtttacctttaattaaccgttcgtaaggtacggtaaggttaacggtttaacgggtttaaactttaacg

SEQ ID NO: 426225 - DNA, 694 bp, Homo sapiens
  misc_feature: GZ8MTXP02GNWAZ.25.4.A04.1.454.CMB.2.raw
  modified_base (279)..(279): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggccggtccctgaccactctcctgcacagccttccggactcacctttggngagcatgctatcgaccgtggtcccgcgaggcctaccgaagggggaaggttctaggggtagtggggtccgtttggggttacaagtttaaggaaaggcggtaaacgtcccgttaagttggggtacggggacctaaaacgaacgtaacgtaccggcccggtacgttaccgtaagggtaaaaacgggcctaaaggtacttcgaacggtccctacgtacgaaaggagattagaacttaacccgaaaagctaaagtccgtaccttacgttacctggacctaacagtgagaccgaggtacctagaaacggacggacggtaacggacttacgaacggtcccggttagttaactttacgtttacgtttaacgttttaacttacccgtttacgtacggtaaggttacggttaacggtttttaagg

SEQ ID NO: 426226 - DNA, 601 bp, Homo sapiens
  misc_feature: GZ8MTXP02FTXXM.25.4.A04.1.454.CMB.2.raw
  modified_base (560)..(560): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaactggtggagtcgtgggggaggcttggtacagccaggccggtccctgacactctcctgcacagccttccggactcacctttggtgagcatgctatgaccgtgggtcccgccaggctccgagggagggtctggagtggcgttgggttcagttagaagcgaagcctagtgggtggggacaaacgacagtacgccgtacgtccgtagtaaaaagggcaaggtattacgacggtccctactacaaagagagtagtaacttaaccgaaaaagccaaacgttccgaccttaactcgttacactaaccaagtgacgctaagccctaggacgaaagcggaaggactcgaacgccgtagttacttacgttnttcgtttaacttccgtacgtagtagtacggttagtttaagg

SEQ ID NO: 426227 - DNA, 587 bp, Homo sapiens
  misc_feature: GZ8MTXP02F5NZE.25.4.A04.1.454.CMB.2.raw
  modified_base (262)..(262): a, c, t, g, unknown or other
  modified_base (307)..(307): a, c, t, g, unknown or other
  modified_base (378)..(378): a, c, t, g, unknown or other
  modified_base (485)..(485): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgttcttttccttgttgctagttttaaaaggtgtccaatgtgaggtgcaacgtggtggagtcgtgggggagccgtggtacagccaggcccggtccctgacactctcctgcacngcttccggactcacctttggtgagcatgctatgacctggggtccnccgaggcctaccgaggggaacgggtctagggagtggtcgttggggttacagttaagagacgaagccgtagngggtggggacaaacactagccgcgcgtataggtaaaaggcagtattcgagtcctactacaaagagatgaattaaccaaaagtcaacgtcacctatctacgacacagngaacgcaagcctagagaacgacgtaggaactcgaacgtccgttagttaaacttcttaagttcctttaaagttcttcgagtacggtaagttaggttttaaacg

SEQ ID NO: 426228 - DNA, 693 bp, Homo sapiens
  misc_feature: GZ8MTXP02GAUCD.25.4.A04.1.454.CMB.2.raw
  modified_base (286)..(286): a, c, t, g, unknown or other
  modified_base (288)..(288): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtaccaatgtgaggtgcaacgtggtggagtcgtgggggagcttggtacagccgaggcccggtcctgacactctcctgcacagtccttccggactctaccgtttggnanctatcgctagtcgtaccgtcggccgcgacggccgtacggaagggtacggtcgtggtaggtcggtcgttggttactagtagaacgtacgtaacgtcgtaggtcgggtacggacaaacgtacgtaccgtccgaccggtacgtaacgtaaggtaaacggcgtacgtacgtccgacgtcctaacgaagaaagacgtacgtaacgtaaccgtaaacgaaacgtacgtaacgttccgaccttacgtaccgtacgaacgtacgtagtacgacgtacgacgacgtaaggaaacggtaacggacggaacggtacgtaccggtacggttaccgtttacgttacgtttaaccgtttgtttaacttaacgttaccgttacggtaacggttaaacggtttacggtttacggtttaacg

SEQ ID NO: 426229 - DNA, 680 bp, Homo sapiens
  misc_feature: GZ8MTXP02J1IYK.25.4.A04.1.454.CMB.2.raw
  modified_base (291)..(291): a, c, t, g, unknown or other
  modified_base (320)..(320): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgacaacgtggtggagtcgtggggggagcttgggacagccaggcccggtccctgacacctctcctgcacagtccgttcccggactccgtacctttggngagcatgctatcggaccgtcggggtcccncgacggtcctaccggaggggtaacgggtctgggacggtggtcgtttggggttctaaggttacgaaggcgaaagccccgtaagtggggtaggggacaacgacagtccggccgtagtacctagggaaaacgcaaacgtattaccaacggtcccttacaacgaagacgtatacgtaactttaaccgaaaaggttccaacgttcccgtacttaactcgttacgacctacgtagtacgacggtacacggtcccgtaggaaacggaacgcggtaacggtacctcgacggtaccggttattactttacgttacgtttactttaacgtacctacgtagtaacggtaggtttacggtttagttttaaac

SEQ ID NO: 426230 - DNA, 825 bp, Homo sapiens
  misc_feature: GZ8MTXP02F84IH.25.4.A04.1.454.CMB.2.raw
  modified_base (194)..(194): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttggcttaactgtcttttccttgttgcttgttttaaaaggtgtccaatgtgaggtncaactgggtggagtcgtggggggaggcttggtacagccgagggccggtccctgacactctcctgcacacgccgttcccggacctctaccgtttggtgagcatgctagtcgaccgttgggtccccgccgacgggcctaccggaaggggaacgggtcgtggggaggttgggtcgtttgggtttacgaagtttaaggaaacggtaccggaaacgtacccgtttagggtaggggttacgggggaaccaaaacccgtaacgtaaccgttacccgggaccccggttacggttacccgttaaaggggttaaaaaacgggctaaagttacgtttaccgacggtacccctactaacgaaaggtaagagttacgtaaacttaaccgaaaaacgtccgtaacgttcccggtaacccttaacttcctacggtacctaaaccgtagttacggaacggaccgaaccggtccgtaacggggaaaaggaaacgggaacggaaaccggtaaccgttcggaaaaccgggtttccccggtttaggttttaaacgtttacccgtttttacggttttaacctttttaaaacgtttttacccggtttagttaacgggttaacgggtttaacggtttaaggttttttaaacggg

SEQ ID NO: 426231 - DNA, 816 bp, Homo sapiens
  misc_feature: GZ8MTXP02GCDLM.25.4.A04.1.454.CMB.2.raw
  modified_base (444)..(444): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctccagataccagatgtgacgtccagatcgacccagtctccactccctcctgtctgctatcgtggttaggagacaagaatcagctacttcacgttcgggccgggacgaggtcgaagggctaagttagtacttaagtttacttacgaccgttaggtaactaaccgaaacgtaacggaaaccgtaggggtactacgttaccgtaaacgtccttaccgtagtaccttacgtacgtcgtaccgttaccgtacccgttaccgtaaaccgtttaccgacccggttaccggtacccggggtacctacgttcgtaccgggttacncggggccggtagtaaggtacgtacgtacgggtacggactacgttacgttaccactacctactaacttacgacccgtagaccctaacgtccgtacgaccgtacggtaccgttaaggtaacgtttacgtttaacggttaccgttaaacgtttaaaccttttacgttaaaacggttaaacgtttaaaacggtaaaaacgtttaccttaaacccgtttacctacccccgggttacccctttacgtttaaccgggttaaccggggtttaccccgggggaaaaggggtaaccggggttaaacccggtaaaaggggtcgggtaaaaacccgttaacggtaaaacccggttaaaaggttcccgggtttaggtaacccggg

SEQ ID NO: 426232 - DNA, 643 bp, Homo sapiens
  misc_feature: GZ8MTXP02H1D91.25.4.A04.1.454.CMB.2.raw
  modified_base (436)..(436): a, c, t, g, unknown or other
  modified_base (450)..(450): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctcctgtctgcatctgttggagacagaatcagcatcacgttggccgggcgagtcgagggcaagttagactaaatttattagccgtaggtaactacgaaacaaggaaaaccgaggggaactaacggtttaccctaaaggccttaccgtgtaattcctagtcgcttcgaccccttacacgttacaccgtcgaacgggtcccagttcgttcggtcacggcggacagtgaactcggtagggaacctagacgtactactctacaacttanacacgacacgtccngacacgcgtagtaagtagtagtacgaacttaaacgttattaacgtaacgtaaaacttaaaagttaaactaaacttaccgtacccgttacccttacgttaccgttaccgggtttaccggggaccgggtaaacgggaaccggtaaagggtacggtaaacgtaaacgtaaaccgtaaaccggtacgttacgggacg

SEQ ID NO: 426233 - DNA, 601 bp, Homo sapiens
  misc_feature: GZ8MTXP02FVP3R.25.4.A04.1.454.CMB.2.raw
  modified_base (260)..(260): a, c, t, g, unknown or other
  modified_base (293)..(293): a, c, t, g, unknown or other
  modified_base (304)..(304): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgcttgttttaaaaggtgtccaatgtgaggtgcaacgtggtggagtcgtgggggagcttggtacagccagggcccggtccctgacactctcctgcacngcttcccggactctaccttggtgagcatgctangaccgtggccncgaggctccgagggaggtctggaggtgtcgttgggttcagttaagacgacgaacgcctagtgggtacggggacaaacgacgagtaccggccgtcgtaccgtaggtaaaagcgagtacttcgacgtccctactacgaagagactagtaacttacccaaaagcataccgaccttatcgtacacaacagtacgagcgacgccgtagacggaagacggaggtaccacgacgtccgttagttacttacgtttcgtttaactttaacttaccgttacgtaggtaacgttaggttagttttaag

SEQ ID NO: 426234 - DNA, 754 bp, Homo sapiens
  misc_feature: GZ8MTXP02JC6N8.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtctccactccctcctgtctgcatcgtggttaggacgacaagaactcagcattccacgttcggccgggcgtacggtcgagggctagttagtactaagtttagttacgctaggtaactaccaaaacgaacggaaaaccggagggtacttaacgttacccgtaagtccttccgtagtacttactagtcgtctccgtcccttaccgtacgttacctaccgtaccggtacggtccctacgttcgttccggttacgccgggtcgtacgtagttacgacgttacgggacgggtaacctacgtacgtttccaacctttcacttaacgtacgtccgacggtacccgcgacctacgaaccggtacgtacgtaacggttaacgtacgttacgttaaaccttaacccgttaagtttaacgttaaacgttaaaacgttaaacgttaaaacttaacgttaacccgttcccgttaccccgttacccgttaccggttaaccgggttaccgggggtaaccggggtaaacccggggtaacgggtaacggttaacgggtaaacggtaacgtaaaccgtaaaaccggtaaacggtacgggttcggtaacg

SEQ ID NO: 426235 - DNA, 868 bp, Homo sapiens
  misc_feature: GZ8MTXP02FHH0L.25.4.A04.1.454.CMB.2.raw
  modified_base (264)..(264): a, c, t, g, unknown or other
  modified_base (283)..(283): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgcttagttttaaaaggtgtccaatgtgaggtgcaacgtggtggagtcgtggggggagcttgggacagccgagggcccggtccctgacactctcctgcacngctccggactcaccttggngagcatgctatcgaccgtcggggtcccgccgacgggccgtaccggaggggtaacggggtcgtggggtaggtgggtcgtttggggtttactaagttaaggaacggtacggaacgcccgttaaggtggggtacgggggaccaaaccgaacaacgtacccgggcccggtaccggttaccgttaaagggtaaaaaacggggccgaaaggtaaactttaccgtaaccggtaccccgttaccgttaaccgaaaaggtaacgaagttaacggtaaacctttaaacccaaaaaaacggaccctaaacgttaccccggtaccctttaacttcccgttacggtaccgtaaaccaacgttagggaacggtaccgtaaaccggacccggttaaagggaaaacggggaaaacggggtaaccggggaaaacggggtaacccgttacccggtaaaccggggttaccccggtttaagggttttaaaaccttttaacccggttttaaggtttttaaccgtttttaaacgtttttaaacccgtttaccggtttaggggttaaaacgggttaaacggggttttaacggggtttttaaaacgggg

SEQ ID NO: 426236 - DNA, 746 bp, Homo sapiens
  misc_feature: GZ8MTXP02F8HXX.25.4.A04.1.454.CMB.2.raw
  modified_base (257)..(257): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttggcttaactgttcttttccttgttgcttagttttaaaaggtgtccaatgtgaggtgcaatggtggagtcgtgggggagcttggacagccgaggtccggtccctgacactctcctgcanagtcttccggactccgtaccgttggtgagtcatgactagtcgaccgtgggtccgcgaggcctaccggaggggtaaggtcgtagggagtgggtcgtttggggttacaagttaaggaagcgtaaaccgtccgtaaggtggggacggggaacaaaccgaacacgtaccgccggtacgttaccgtaaaggtaaaaggctaagtacttcgacggtacccttacgtaacgaaagagtagttaacgaacctttaaaccgaaaaaacgtcctaaaccgtacccggtaacccttaagttccgtacgacgtaaccaacgttaggaacggtaccccaaggtccccgtaagggaaaacggaacgggttacgggaaacgacccgttaaacggaacccggttaccgggttagtttaaacctttacggtttacgtttaacccgttttaaatttacccgttaacgtacggttaaacggtacggttttaaggtttttaaaacccgg

SEQ ID NO: 426237 - DNA, 658 bp, Homo sapiens
  misc_feature: GZ8MTXP02FW12N.25.4.A04.1.454.CMB.2.raw
  modified_base (294)..(294): a, c, t, g, unknown or other
  modified_base (320)..(320): a, c, t, g, unknown or other
  modified_base (475)..(475): a, c, t, g, unknown or other
  modified_base (542)..(542): a, c, t, g, unknown or other
  modified_base (579)..(579): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttggcttaactgttcttttcctgttgcttagttttaaaggtgtaccaatgtgaggtgacaacgtgggtggagtcggtgggggagtcgttaggtacaggcccgagggcccggtccctgaccactctcctgcacagtccgttccggactctacgtttggngagcatgctagtcgaccgtcggtccncgaggcctacggaaggggtaggtcgtaggaggttggtcgtttggtactagttaaggagacgagtccccgtaggtcggggtacggactaaacgacaacgtcccggccgacgttacgtaaaggtaaaacgcgtaagttacttccgacgtacccttanaacgaagtaacgagtctaaacgtaaccaaaagtctacgtacccgtactagttacacgtaccagttanacggacacgtacgacagggaaacgacgttcggaaacnctacggaacggttcctaggtttaacttacgttagtttaacttaagtcgtagtagtagttacggtagtttattttaaacc

SEQ ID NO: 426238 - DNA, 637 bp, Homo sapiens
  misc_feature: GZ8MTXP02IK98A.25.4.A04.1.454.CMB.2.raw
  modified_base (226)..(226): a, c, t, g, unknown or other
  modified_base (344)..(344): a, c, t, g, unknown or other
  modified_base (454)..(454): a, c, t, g, unknown or other
  modified_base (553)..(553): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccactccctccctgtctgctatcgtggttggggacagaatcagcatcacttggccgggngagtcaggggctatagctaattattagctaggtactcaaacacgaaaccgagggagtaacgttaccgtaagcctacctagattctagtgtccgttcgccccttacctaccgttaaccnccgttaccgtaaccggggttcccctagttccgttccggtttacgacgggccggggtactaggttacgtaacgtccggtaggggactagtacgttcaccttctactactanacgacgcacgcgtcgacgacgtaccgtagaagtagttcgtagaaccttaacgtttactaacgttaagtaaacgtaaattaactactacctctacccttntaccggttaacgttcggggacggtaacggtaccgtaaggggtaagtaacgtaactaaccgtaaacgtacgtgggttacggtccg

SEQ ID NO: 426239 - DNA, 736 bp, Homo sapiens
  misc_feature: GZ8MTXP02IK040.25.4.A04.1.454.CMB.2.raw
  modified_base (455)..(455): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatcgacccagtcctccactccctcctgtctgctatctgttggagacagaatcagcactctacgttcggcccgggagacgtcgagggtactattagactaattattagccgtagtataccaaacgacgaaaccgagggagacgttacctagcctccgtagactctagtcgtctccgtcctaccgtaccgtactaccccgtcggtaccgggtccctacgttccgtcggttacgacgggccggtactagggttacgtacgtcggaggggtaactaaggtcttcccaacctctaactaacttacncgacgtaccgaccgtccgtacgaccgtacgtaaccgtaagggtaacgttcgtttaacggtacgtaaaccctttaaacggtttaactttaccgtaaaagggttaaaacctttaaaaagttaaccttaaacgttacccgttaccccgggttacccccttagggtttaacccccggtttaaaccggtttcggggggaaaccccgggtaaggggttaaacccgaaagggggttaggaaaccttaaaacgggtaaaccgaaaaccgggttacgttgggtaacccgg

SEQ ID NO: 426240 - DNA, 625 bp, Homo sapiens
  misc_feature: GZ8MTXP02F0SP6.25.4.A04.1.454.CMB.2.raw
  modified_base (199)..(199): a, c, t, g, unknown or other
  modified_base (476)..(476): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccactccctccctgtctgctatcgtgttgganacagaatcagcatcacgttcggccgggacgagtcgagggactattagactaattattacgcctaggtactacaaacgaagaaaccgagggtagtagttaccctaagcctaccgtgaattcaatcgcgttcgaccctaccgtaacgttaccacccgtacgacgggttacccagttccgttcggttacgacggggccgtacgtaaaggttacgaacgtttcgggagggtaaccgtagtaccgtttacaccgttactactaacgtatccaagtcacgtcngacgctacgtagaactgttgtaacacctttaaatttctaacgtagttaaataaaacgtacttaaacgtcctactcccttataccggtacgttcggaacgggccgtaaacgaagtacggaaactacgtaacgaacgtacggtcttaacgg

SEQ ID NO: 426241 - DNA, 506 bp, Homo sapiens
  misc_feature: GZ8MTXP02JCEGK.25.4.A04.1.454.CMB.2.raw
  modified_base (266)..(266): a, c, t, g, unknown or other
  modified_base (333)..(333): a, c, t, g, unknown or other
  modified_base (374)..(374): a, c, t, g, unknown or other
  modified_base (379)..(379): a, c, t, g, unknown or other
  modified_base (387)..(387): a, c, t, g, unknown or other
  modified_base (405)..(405): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtctccatcctccctgtctgcatctgttgagacagaatcagcatcacttgccggcgagtcaggcatagcaattattagcctgtatcaaacaacgaaacgagganagttccaagctctgatctatgctcgtcctctacgttacacctcgacgggtcccattcgtccggttcngtcggcagttagaagtcgtaggactagtgttccactctacnctacncagcagcngcagcgtagatagtgtanaactaacttatagtataactaaatatactacctctcccttactcgttaccgttcggacggacgtacgtaaggtacgaacgactaacgaacgtacgtcgtcg

SEQ ID NO: 426242 - DNA, 643 bp, Homo sapiens
  misc_feature: GZ8MTXP02JF0U4.25.4.A04.1.454.CMB.2.raw
  modified_base (177)..(177): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaagngtccaatgtgaggtgcaactggtggagtctgggggagcttgggtacagccaggccggtcctgacactctcctgcacagcttccggactcaccttggtgagcatgctatcgacctggtccgcctaggctccgaggggaaggtctaggagtggcttgggtcagttagagcgaagcctagtcggtaggggacaaacgactaacgtaaccggccccggagttacctaaggtaaaaacgggccaaggtaaactttccgaaaggttccctcttaccgaaaagaggtaattagaagtttacccaaaacgtaacgaactaccggtaccttaacgtaccgttacgtacgtactacgtacgacgacgacgtacgtacgaacgaacggacggacggacgtacgtacgtaccgtacgttacgttacgttacgtttaacgtttacttacgttacgtacgtacggttacggttagttacg

SEQ ID NO: 426243 - DNA, 710 bp, Homo sapiens
  misc_feature: GZ8MTXP02IXI3E.25.4.A04.1.454.CMB.2.raw
  modified_base (295)..(295): a, c, t, g, unknown or other
tcagactgtacagtcacgaccggtgctcgatttagagtagtgatcagggggagctctgggagaggagccccagccgtgagattcccaggagtctccacttggtgatcagcactgaacacagaccaccaaccatggagtttgggcttaactgttcttttccttgttgcttagttttaaaaggtgtaccaatgtgaggtgcaacgtggtggaggtcggtggggggaggtcgttggtacagccgagggcccggtccctgacactctcctgcacagccttccggactctaccgtttggngagctatgctagtcgaccgtggggtcccgccgagggcctccggaaggggaacgggttcgtaggggtaggtcgggtcgtttggggttacaagtttaaggaaacgacgaaacgccgttaagtcggggtaggggacaaaacgaacaacgtccgacccgtacgttaccgtaaggtaaaaacgggcaaagtacttacgaacgtccctactaacgaaaagagtaatacggtaaacttaacccgaaaaagtcctaaactcccgtaacccttacttaccgttacgacaaaccgtagtagacgactacgccttaagggaacgaacggacggaacggtactaccggaggtacccgttaggtttaacttaaccgtttgtttaaccgtttaattacgtacgttaggacggttagtttaacggtttag

SEQ ID NO: 426244 - DNA, 698 bp, Homo sapiens
  misc_feature: GZ8MTXP02GVRSF.25.4.A04.1.454.CMB.2.raw
  modified_base (245)..(245): a, c, t, g, unknown or other
  modified_base (309)..(309): a, c, t, g, unknown or other
tcagactgtacagtcacgaccggtgctcgatttagagtagtgatcaggggagctctgggagaggagccccagccgtgagattcccgggagtctccacttggtgatcagcactgaacacagaccaccaaccatggagtttgggcttaactgttcttttccttgttgcttagttttaaaaggtgtccaatgtgaggtgcaactggtggagtcgtgggggagcttggtacagccaggccgtcctgacnctctcctgcacagtccttccggactctaccgtttggcgagcatgctagtcgaccgtcgggtccnccgtaggcctccggaaggggacggtcgtaggagtcggtcgtttgggtacagttaagaagacgtaagcccctaaggtcggggtaggggaaccaaacgaacctaaacgtccggcccgtacggttacctaaagggtaaaaacggctaaagtctttacgaacgtccctactacgaaaggtaagtacgtacgtaaccttaaacccgaaaaaggcctaacgtccgtacccttaatcctacgccaaactatagacgacgacgaccgtacggaacgaaaggaacggaacggaaccgtaccgaaccggtaccggtaccgttacgttaactttacgtttacgtttaacgtttaacttaccgttacggtagtaacggttacggtttacggtttttaaacg

SEQ ID NO: 426245 - DNA, 716 bp, Homo sapiens
  misc_feature: GZ8MTXP02FMORZ.25.4.A04.1.454.CMB.2.raw
  modified_base (185)..(185): a, c, t, g, unknown or other
  modified_base (277)..(277): a, c, t, g, unknown or other
  modified_base (308)..(308): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttccttgttgctgttttaaaggtgtccaatgngaggtgcaacgtggtggagtcgtggggagcttggtacagccgaggccgtcctgacactctctgcacagccttccggactcctaccgtttggngagcatcggctagtcggacctcggggtcccncgaggccgtaccggaggggtaaggtccgtgggacgtggtcgttgggttacagttaaggaagccgtaacgccccgttaggtggggtacgggacctaaacgactaaacgtcccgggcccgtacgttaccgtaaggtaaaaacgcgtaaagtccgttacgacgtaccccgttactaacgaaaggtaagtacgtacggtaactttaaaccccgaaaaggtaccctaacgttacccggtaccttaaacgttcccgtagacctaaccgtaagtacggacgtaccgtaggtaccccgtagggaaaacggacgtcgggaaacgtacctaccgtacggtaccgttaggttactttaccgtgttttaacgttaacttcgtaacgtaggtacgttaaggttacgtttacggtttaaacg

SEQ ID NO: 426246 - DNA, 606 bp, Homo sapiens
  misc_feature: GZ8MTXP02JO77C.25.4.A04.1.454.CMB.2.raw
  modified_base (191)..(191): a, c, t, g, unknown or other
  modified_base (356)..(356): a, c, t, g, unknown or other
tcagactgtacagtcacgaccggtgctcgatttagagtagtgatcagggggctctgggagaggagccccagccgtgagattcccaggagtctccacttggtgatcagcactgaacacagaccaccaaccatggagtttgggcttaactgtcttttcctgttgctgttttaaaaggtgtccaatgtgaggtncaactggtggagtcgtgggggaggcttggtacagccagggcccggtccctgacactctcctgcacagcttccggactcacctttggtgagcatgctatcgaccgtgggtcccgcaggcctccgaggggaggtctgtagtggtctttgggttcagttagagcgaancccctagtggggtagggacaacacgaactaccggcccgtacggttactaaggtaaaaggctaaagtcttacgaacgtcctactacaaaggagatagtaacttaacgaaaagcaatccgtacctagtctcgacacgatcgacgctacgacctaggaagaacgcggaacggcctacgacggtacccgttagttactttaacgttcgtttacttaacttaccgtctaggagtacgttacggttagttttaaac

SEQ ID NO: 426247 - DNA, 816 bp, Homo sapiens
  misc_feature: GZ8MTXP02JVDBA.25.4.A04.1.454.CMB.2.raw
  modified_base (178)..(178): a, c, t, g, unknown or other
  modified_base (260)..(260): a, c, t, g, unknown or other
  modified_base (282)..(282): a, c, t, g, unknown or other
  modified_base (336)..(336): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgtcttttccttgttgctgttttaaaaggngtccaatgtgaggtgcaactggtggagtcgtgggggagcttgggtacacgccgaggccggtccctgacacgtctcctgccanagcctccggactcacgtttggngagtcatgctagcgaccgtggccgcaggcctcgagggaggtctgggagtgggtnttggggttcaagttaagaacgtcgaaaccgtccgtagtcggggtaggggacaaacgactacgtaccgcccggtacgtaccgtaggtaaaacgggctaaacgtacttacgacgtacccgtacgttacgaaaacggtacgtaacgttaaggtaaaccgtttaaaccccaaaaaaggtacctaaaaccgggtttcccggtaaacccccgtttaaagtttaccctttaacggggaacccgttaaaccccgaaatttaaacccgggaacgggtacctaaaaccgggcccccggttaaggggaaaacccggaaaagggacccgggaaaaacgggggtttcccaccccggtaaaggggtttacccccgtttacgggtttaaaccttttaaccggtttaacggtttttaacccccgttttaatttttaaaacccggtccgtttaaagggtttaacggtaaaacggttttaacgggtttttaaacccgg

SEQ ID NO: 426248 - DNA, 843 bp, Homo sapiens
  misc_feature: GZ8MTXP02FHZ0I.25.4.A04.1.454.CMB.2.raw
tcagactgtacagtcacgaccggtgctcgatttagagtagtgatcagggggcagaagtctctctcagtcaggacacagcatggacatgagggtccctgctcagctcctgggactcctgctgctctggctcccagataccagatgtgacgtccagatgacccagtcctccatccctccctgtctgcatcgtgttggagacagaatcgagcactctacgttggcccgggtcgagtcgaagggctagtagctaaattattagcctaggtactacgaaactaagaaaaccaggggaagtacgttaccgtaaagtccttaccgtagtactttacgtaacgtgaccgtttcgtacccccttaccgttaaccgtttaccgtaacccgtcccggtaaaccggggtcccccttaaacgtttcccggttaacccgggtttaccgtaacggggcccgggtacccgtttaaaggggaaccgttaaaaccggttacgggtttaaccgggggaaacccgttaaggggttaacccggtttaacccgtaaacccgttaccttaccccgttaaactttaacgtaccgtaaaacgccgttaacggtaaccccgttccggaacgaaacccggtaccgttaaccggtaaaaggttacgttacgggtttacgtaaaacccgtttaacgtttaaacctttaacgttaaacgttaaacgtaaaacgtttaaaacgtaaaactttacccgtaccggttaaccccttcgttaacccgtaccggttttaaaccgggaccggggtacggaaaacggttaacgggtacggtaaacgaacggttaaccaaaaaccggtacgaaggttaccgg

SEQ ID NO: 426249 - DNA, 682 bp, Homo sapiens
  misc_feature: GZ8MTXP02JB4UC.25.4.A04.1.454.CMB.2.raw
  modified_base (283)..(283): a, c, t, g, unknown or other
tcagactgtacagtcacgaccggtgctcgatttagagtagtgatcaggggagctctgggagaggagccccagccgtgagattcccaggagtctccacttggtgatcagcactgaacacagaccaccaaccatggagtttgggcttaactgttcttttccttgttgctgttttaaaaggtgtccaatgtgaggtgcaactggtggagtcgtgggggagcgttggtacagccgaggccggtccctgacactctcctgcacagtcttccggactctaccgtttggngacgctagtcgacttagtcggtacccggtcgggtccccgaccgtacggccgtaccggaaggggtacgggtcgtagggtaggttcgggtcgtttgggtactaagttaaggaaggacgaaccgtaccgtaggtcggggtacgggaccaaaccgaacgtacgtaccggcccggtacgtacgtaaggtaaacggctaagtactcgtacgtcctacgtaacgaaagagtacgtagtaacttaaccgaaaacgtctaacgtacctacttactactcgacacgagtcgacgacgacgtcgagaacggaacggacggaacggacctacggtaccggtcgttacgttactttacgtttacgtttaacttacgttacgttacgtagtacggttaacgtttacggtttag

SEQ ID NO: 426250 - DNA, 688 bp, Homo sapiens
  misc_feature: GZ8MTXP02FXWM6.25.4.A04.1.454.CMB.2.raw
  modified_base (186)..(186): a, c, t, g, unknown or other
  modified_base (189)..(189): a, c, t, g, unknown or other
  modified_base (198)..(198): a, c, t, g, unknown or other
  modified_base (202)..(202): a, c, t, g, unknown or other
  modified_base (262)..(262): a, c, t, g, unknown or other
  modified_base (304)..(304): a, c, t, g, unknown or other
  modified_base (310)..(310): a, c, t, g, unknown or other
tcagactgtacagtcacgaccggtgctcgatttagagtagtgatcagggggcagaagtctctctcagtcaggacacagcatggacatgagggtccctgctcagctcctgggactcctgctgctctggctcccagactaccagatgtgaccgtcagatcgaccctagtcctccatccctcctgtctnacntctggtganacanaatcagctatcagttcggccggcgtagtccgagggctagttagctaattattacccccgngtagtataacaacgtaagaacgtagggatcgtaccagctcgngctagntcgctcgtacctaccgtacgttacgacccgttacgtacccggggtcctattcccggtccggtttagacggtccgggaactaggtaaccgtccgttagggtcggggaaaactcggggtacgtttaaccctacccgttacttacgttaaacctacgtcgtaacgtaccgtaccgtaccgaccgtacgacgtacgtaacgtaagttacgttacgttacgttaacgttaactttaacttaacttaacgtaaacgtaaacttaacttaactacctacccgttacccttaccgttaccgttaccggttaccgggtaccgggtaacggtaaccggtaacggtaacggtaacgtaaacgtaaaccggtaaacggtaacgtacgtcg

SEQ ID NO: 426251 - DNA, 446 bp, Homo sapiens
  misc_feature: GZ8MTXP01BA4ZA.3.17.B06.1.454.CMB.2.raw
  modified_base (441)..(446): a, c, t, g, unknown or other
tcagagacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacacgacggtggtacctggtattcgcggtgggtctactggggccagggaaccctggtcaccgtctcctcagcctccaccaagggcccatcggtcttccccctggccgccctgctccaggagcacccctccgagagcacaagccggccctggggctgcctggtcaagggctacttccgagtgcgtctctgagcgggctggcaaggcgcagtagnnnnnn

SEQ ID NO: 426252 - DNA, 440 bp, Homo sapiens
  misc_feature: GZ8MTXP01EA0DP.3.17.B06.1.454.CMB.2.raw
  modified_base (436)..(440): a, c, t, g, unknown or other
tcagagacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtgtacctggtattcgcggtgggtctactgggccagggaaccctggtcaccgtctcctcagcctccaccaaggcccatcggtcttccccctggcgccctgctccaggagcaccctccgagagcacaagcggccctgggctgccctggtcaagggactacttccgagtgcgtctctgagcgggctggcaaggcgcatagnnnnn

SEQ ID NO: 426253 - DNA, 546 bp, Homo sapiens
  misc_feature: GZ8MTXP01D2VE0.3.17.B06.1.454.CMB.2.raw
  modified_base (376)..(376): a, c, t, g, unknown or other
  modified_base (464)..(464): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctctggactcaccttcacgctcaatggccactacgtggactggggtcccgccaggctccgaggggaaggggctgggagtgggtggccgttctagagacacaactaacagtgacaaccgnaacataccgccgcgtctgtgaaaggcagattcaccatctacaagagatgattcaagagaactctactttaatctgactaaatgaaacngacctagacgaaccgaacgacacgggccgttcgtattattgttgttctaatagcctagggattacgtaacggcggttaacgg

SEQ ID NO: 426254 - DNA, 565 bp, Homo sapiens
  misc_feature: GZ8MTXP01B9RZR.3.17.B06.1.454.CMB.2.raw
  modified_base (272)..(272): a, c, t, g, unknown or other
  modified_base (274)..(274): a, c, t, g, unknown or other
  modified_base (277)..(277): a, c, t, g, unknown or other
  modified_base (312)..(312): a, c, t, g, unknown or other
  modified_base (317)..(317): a, c, t, g, unknown or other
  modified_base (415)..(415): a, c, t, g, unknown or other
  modified_base (426)..(426): a, c, t, g, unknown or other
  modified_base (451)..(451): a, c, t, g, unknown or other
tcagagacgcactccacgaccggtgctcgatttagtcgatagtgaaggggagctctgagagcggagccccagcccagaattcccaggtgttttcatttggtgatcagcactgaacacagaggactcaccatggagtttgggctgagcgtggtttcgtgtaggttatttacaaggtgtcagtgtgaggtgcacctggtggagtcgtgggggagcttgggtccagcctgggaggtccctaaagctctcctgtgcagctctggctcacttcaccncncancgcactacgtgcgtcggtcgcgcgcgcgaggaggngtggnggtggtggtcgtcgtagagacaccaacaacagacgacaaccgacaacaactacgccgcgtcgtagtagaagacgagtactacacactacacaagaganagatacagaanaacgtactacttactactagacaanagaacacgtacgtacgaacgaacgaacgaacgacgtacgttacgttacgttagttagttcgttacgtaataacgtaacgtaacgtaacgttaacgtaacggttaacggtaacgg

SEQ ID NO: 426255 - DNA, 583 bp, Homo sapiens
  misc_feature: GZ8MTXP01CDTLQ.3.17.B06.1.454.CMB.2.raw
  modified_base (296)..(296): a, c, t, g, unknown or other
  modified_base (332)..(332): a, c, t, g, unknown or other
  modified_base (402)..(402): a, c, t, g, unknown or other
  modified_base (407)..(407): a, c, t, g, unknown or other
  modified_base (431)..(431): a, c, t, g, unknown or other
  modified_base (444)..(444): a, c, t, g, unknown or other
  modified_base (452)..(452): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaggtgtccagtgtgaggtgcactggtggagtcgtgggggagcttggtccagcctggagggtccctaagctctcctgtgcagcctctggactcaccttcacgctcaatggccactacgtggactgggtccnccaggctccgaggggaggctgggagtgggtgcgttnagagacacaactacagtcgacacgcaacaataaccgccgcgtctgtagaaaggcaagattcaccatctanaaganatagatcagacaactctactttancgtagaactaaanacgaaacncgcctaggaaacgaacccgtacgaacgaccggtcctaacttaatttagttgttacgtactaagttaacggaccgttaagggaactaacggaacggtacgggttacggttaccgttgggttaacgttcgggg

SEQ ID NO: 426256 - DNA, 513 bp, Homo sapiens
  misc_feature: GZ8MTXP01EZYJ8.3.17.B06.1.454.CMB.2.raw
  modified_base (299)..(299): a, c, t, g, unknown or other
  modified_base (359)..(359): a, c, t, g, unknown or other
  modified_base (395)..(395): a, c, t, g, unknown or other
  modified_base (399)..(399): a, c, t, g, unknown or other
  modified_base (401)..(402): a, c, t, g, unknown or other
  modified_base (409)..(409): a, c, t, g, unknown or other
  modified_base (419)..(419): a, c, t, g, unknown or other
  modified_base (423)..(423): a, c, t, g, unknown or other
  modified_base (436)..(436): a, c, t, g, unknown or other
  modified_base (472)..(472): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggaggcttggtccagcctgggagggtccctaagactctcctgtgcagcctctggactcaccttcacgctcaatggccatacgtgactgggtccnccaggctcaggggagggctggagtgggtgcgtctagagacacaactaacagtcgacacgnacaataccgcgctctgagaaagcagattcacatcanaganannatcaganactctattanctanacaaatagacacncgagacgaacgacgacgacgcgtctattatgttgtntattagacagaatacgaacgacggtacgttacgtcgttgtg

SEQ ID NO: 426257 - DNA, 561 bp, Homo sapiens
  misc_feature: GZ8MTXP01EVG09.3.17.B06.1.454.CMB.2.raw
  modified_base (252)..(252): a, c, t, g, unknown or other
  modified_base (370)..(370): a, c, t, g, unknown or other
  modified_base (386)..(386): a, c, t, g, unknown or other
  modified_base (423)..(423): a, c, t, g, unknown or other
  modified_base (440)..(440): a, c, t, g, unknown or other
  modified_base (453)..(453): a, c, t, g, unknown or other
  modified_base (469)..(469): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttatttacaaggtgtccagtgtgaggtgcacctggtggagtcgtgggggagcttggccagcctggaggtccctaagctctcctgtgcagcctntggactcaccttcacgctcaatcggccactacggtggactgggtcccgcaggctccgaggggaagggctgggaggtgggttggccgtttctagacgacaacaactaacagtcacacgnaacaactaaccgccgngtctagggtagaaaaggcaagacttccaccatcctanaagagatagattcaganaactctactttanctagactaaatgaacncgcctagaacgaacccgagaccacgggcctaatattatgttgtcaattcgacttaggaatacgaacggacggtcgttactggttcgttcggg

SEQ ID NO: 426258 - DNA, 550 bp, Homo sapiens
  misc_feature: GZ8MTXP01B7FXT.3.17.B06.1.454.CMB.2.raw
  modified_base (301)..(301): a, c, t, g, unknown or other
  modified_base (431)..(431): a, c, t, g, unknown or other
  modified_base (492)..(492): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccnccaggctccgaggggaaggggctgggagtggggttggccgtttctagagacacaactaacagtcgaccacgcaacaataacgccgcgtctgtgaaaggcagattcaccatctacaagagatgattcaganactctatttactctgaactaaatacgaacacgcctagaacgaaccgacgacaccggccgtntattatgttgtcagttagacttaggaatacgaacgtacggtgttacctggttgtcggg

SEQ ID NO: 426259 - DNA, 549 bp, Homo sapiens
  misc_feature: GZ8MTXP01B3JUP.3.17.B06.1.454.CMB.2.raw
  modified_base (304)..(304): a, c, t, g, unknown or other
  modified_base (340)..(340): a, c, t, g, unknown or other
  modified_base (378)..(378): a, c, t, g, unknown or other
  modified_base (402)..(402): a, c, t, g, unknown or other
  modified_base (407)..(407): a, c, t, g, unknown or other
  modified_base (431)..(431): a, c, t, g, unknown or other
  modified_base (476)..(476): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtcagtgtgaggtgcacctggtggagtcgtgggggaggcttggtccagcctgggagggtccctaagactctcctgtgcagcctctggactcaccttcacgctcaatcggccactacggtggactgggtcccncaggctccgaggggagggctggagtgggtgccgttnagagacacaaatacagtcgacacgcacaataacgccgngtctgtagaaagcagatcacatcnaaganatagattcagagaactcaatttanctgaacaaatgaaacagcctagaacgaaccgacgacgccggcctnttattattgttgtactaattacgaccgaggtaactaacgaacggtacggtggttaccgtggttaacgttcggg

SEQ ID NO: 426260 - DNA, 543 bp, Homo sapiens
  misc_feature: GZ8MTXP01CPYFX.3.17.B06.1.454.CMB.2.raw
  modified_base (298)..(298): a, c, t, g, unknown or other
  modified_base (342)..(342): a, c, t, g, unknown or other
  modified_base (359)..(359): a, c, t, g, unknown or other
  modified_base (369)..(369): a, c, t, g, unknown or other
  modified_base (401)..(401): a, c, t, g, unknown or other
  modified_base (404)..(404): a, c, t, g, unknown or other
  modified_base (450)..(450): a, c, t, g, unknown or other
  modified_base (478)..(478): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggaggtccctaagctctcctgtgcagcctctggactcaccttcacgctcaatggcccactacgtggactgggtccnccaggctccgaggggaaggggctgggagtggggttggccgtttntagagacacaactaacngtcgacacgnacaatacgcgcgtctgagaaaggcagatcacntcnaagagatagattcagagaactcactttatctagactaaatgaaacngcctagaacgaaccgcgacacgggcctntattagtgttgtacattacgaccttaggaatacgaacgacggtggttacctgggttaattccggg

SEQ ID NO: 426261 - DNA, 558 bp, Homo sapiens
  misc_feature: GZ8MTXP01D8VPP.3.17.B06.1.454.CMB.2.raw
  modified_base (424)..(424): a, c, t, g, unknown or other
  modified_base (428)..(428): a, c, t, g, unknown or other
  modified_base (430)..(430): a, c, t, g, unknown or other
  modified_base (435)..(435): a, c, t, g, unknown or other
  modified_base (453)..(453): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctctggactcaccttcacgctcaatggccactacggtggactgggtcccgccaggctaccgaggggaggggctgggagtggggttgccgttcagacgaccacaaactaacagtgaaccaccgcaacaaataccgccgcgtcgtgtagaaaggcagtatcacatctanaagnangatanagagaactctaactttanctagacaaatacgaacacgtcctaggaacgaaacccgacgacgaccgggttccgtattattagttgttgtaacagtaagacctagaactaaccgaacggtaacgg

SEQ ID NO: 426262 - DNA, 562 bp, Homo sapiens
  misc_feature: GZ8MTXP01CJLZU.3.17.B06.1.454.CMB.2.raw
  modified_base (265)..(265): a, c, t, g, unknown or other
  modified_base (297)..(297): a, c, t, g, unknown or other
  modified_base (304)..(304): a, c, t, g, unknown or other
  modified_base (315)..(315): a, c, t, g, unknown or other
  modified_base (409)..(409): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtggtttcgtgttaggttatttacaagtgtcagtgtgaggtgcacctggtggagtcgtgggggaggcttggtccagcctggaggtccctaagactctcctgtgcagcctctggactcaccttnacgctcaatggccatacgtggactgggtcccncgaggcncgaggggaggntggagtgggtcgcgttgagagacacaactacagtcgaccacgacacaactaccgccgtcgtctaggtaagaaacggcaagtactacactatcanaagagatagattacgagagactactacttatacgtactaactaatagaacacgacgacgaacgaacgacgacgacgcgtaactattagttgttgtactattacgttacgttacgtaagtaacgtaacgtacggtacggttacgtcgttcgtcg

SEQ ID NO: 426263 - DNA, 543 bp, Homo sapiens
  misc_feature: GZ8MTXP01DK63M.3.17.B06.1.454.CMB.2.raw
  modified_base (301)..(301): a, c, t, g, unknown or other
  modified_base (383)..(383): a, c, t, g, unknown or other
  modified_base (408)..(408): a, c, t, g, unknown or other
  modified_base (440)..(440): a, c, t, g, unknown or other
  modified_base (454)..(454): a, c, t, g, unknown or other
  modified_base (492)..(492): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggagggtccctaagactctcctgtgcagcctctggactcaccttcacgctcaatggccactacgtggactgggtccnccaggctccgaggggaaggggctgggagtggggttggccgttctagagacacaactaacagtcgacacgcacaatacgccgngtctgtagaaaggcagattcacctntctcaagagatgattcagagaactcaatttanctgacaaatgaacngcctagaacgaaccgacgacacggcgtaactattatgngtcattacgcttaggaataacgaacgacggtgttacctggttaacgttcgg

SEQ ID NO: 426264 - DNA, 541 bp, Homo sapiens
  misc_feature: GZ8MTXP01EZA0V.3.17.B06.1.454.CMB.2.raw
  modified_base (262)..(262): a, c, t, g, unknown or other
  modified_base (311)..(311): a, c, t, g, unknown or other
  modified_base (318)..(318): a, c, t, g, unknown or other
  modified_base (374)..(374): a, c, t, g, unknown or other
  modified_base (422)..(422): a, c, t, g, unknown or other
  modified_base (427)..(427): a, c, t, g, unknown or other
  modified_base (439)..(439): a, c, t, g, unknown or other
  modified_base (453)..(453): a, c, t, g, unknown or other
  modified_base (459)..(459): a, c, t, g, unknown or other
  modified_base (464)..(464): a, c, t, g, unknown or other
  modified_base (469)..(469): a, c, t, g, unknown or other
  modified_base (505)..(505): a, c, t, g, unknown or other
  modified_base (510)..(510): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctggagggtcccctaagctctcctgtgcagcctntggactcaccttcacgctacaatcggcccactacggtggactgggtccnccaggcnccgaaggggagggctgggaggtgggtgccgtcagagaccacaactacagtgaaacncgcacaaataccgccgcgtctgtagaaaggcagaattcaaccattcanaaagngatgatacaganaacttcaactttanctaganaatanaacanacgacgacgaacgacgacgacgcgtactattagttnttgtntataacgtacgtagacgtaacgaacgtaacg

SEQ ID NO: 426265 - DNA, 543 bp, Homo sapiens
  misc_feature: GZ8MTXP01EJK6M.3.17.B06.1.454.CMB.2.raw
  modified_base (297)..(297): a, c, t, g, unknown or other
  modified_base (331)..(331): a, c, t, g, unknown or other
  modified_base (347)..(347): a, c, t, g, unknown or other
  modified_base (357)..(357): a, c, t, g, unknown or other
  modified_base (371)..(371): a, c, t, g, unknown or other
  modified_base (397)..(397): a, c, t, g, unknown or other
  modified_base (425)..(425): a, c, t, g, unknown or other
  modified_base (442)..(442): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagctctcctgtgcagcctctggactcaccttcacgctcaatggccatacgtggactgggtccnccaggctcgaggggaggctggagtgggtgcgttnagagacacaactaacngtcgacacgnaacaataacgccgngtctgtagaaaggcagattcacatcnaagagatgattcagagaactcactttanctagacaaatcgaaacngcctagaacgaaccgacgacacgggcctctaattatgttgtacagttacgaccttaagggaatacgaacgacgggtggttaccgtgggttaacgttccggg

SEQ ID NO: 426266 - DNA, 653 bp, Homo sapiens
  misc_feature: GZ8MTXP01COTUY.3.17.B06.1.454.CMB.2.raw
  modified_base (305)..(305): a, c, t, g, unknown or other
  modified_base (439)..(439): a, c, t, g, unknown or other
  modified_base (448)..(448): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggacgggtccctaagctctcctgtgcagcctctggactcaccttcacgctcaatcggccacgtacgtggactcgggtcccnccaggcctccgagggggaacggggctggggaggttgggggttcggccgtttctaaggacgacacaaactacagtcgacacgcaacaactaaccgccgcgtctgtagaaaggcagattccaaccatctacaaganatgaacttnaagagtaaccttctaactttagttctagtaactaaaactggaaacacgcccgtaggaaacgaaacccgaccggtaaccaccgggtcccgttaacttagtttagttgttacgtaaccctaagttacggttaacccgttagggtaacctaaacgaaacccgggtcggggttacggtttaccccggtggtttaaccggtttcccgggg

SEQ ID NO: 426267 - DNA, 587 bp, Homo sapiens
  misc_feature: GZ8MTXP01EUKMK.3.17.B06.1.454.CMB.2.raw
  modified_base (298)..(298): a, c, t, g, unknown or other
  modified_base (317)..(317): a, c, t, g, unknown or other
  modified_base (335)..(335): a, c, t, g, unknown or other
  modified_base (353)..(353): a, c, t, g, unknown or other
  modified_base (456)..(456): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggaggcttggtccagcctggagggtccctaagactctcctgtgcagcctctggactcaccttcacgctcaatggccatacgtggactgggccnccaggctccgaggggaggntggagtgggttgccgttnagagacacaaactaaacngtacgacaccgcaacaagtaaccgccgcgtctaggtagaaaagggcaagtattccaacctatctacgaaagagaatagatttcaagagaaactcaacttttanacttagacaaaatcgaaacagcccgtagaacgaaccgacgaacacgggcctaataagttatgttgtctaattacggaccttaaggaataaccgaacggtacggtaggttacccgtgggttaacgttccggg

SEQ ID NO: 426268 - DNA, 616 bp, Homo sapiens
  misc_feature: GZ8MTXP01CM3PQ.3.17.B06.1.454.CMB.2.raw
  modified_base (298)..(298): a, c, t, g, unknown or other
  modified_base (336)..(336): a, c, t, g, unknown or other
  modified_base (362)..(362): a, c, t, g, unknown or other
  modified_base (401)..(401): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagctctcctgtgcagcctctggactcaccttcacgctcaatggccactacgtggactgggtccnccaggctccgaggggagggctggagtgggtgccgtttnagagacacaaactacagtcgacacgnacaaatcgccgctctgagaaagcagattcacctatccanaagagatagattacagagaactactactttattactacgtactaaataagaaacaacgaccgtacgaacgaaaccgaaccgaaccgaaccggtacccggtaaccgttaacgtttaactttacgttaggttacctaagttaacgttaaccgttaacggtaagttaaacgaaacggtaacgggtacgggttaccgttaacggttaacgtttccgggg

SEQ ID NO: 426269 - DNA, 525 bp, Homo sapiens
  misc_feature: GZ8MTXP01EZBGJ.3.17.B06.1.454.CMB.2.raw
  modified_base (301)..(301): a, c, t, g, unknown or other
  modified_base (338)..(338): a, c, t, g, unknown or other
  modified_base (354)..(354): a, c, t, g, unknown or other
  modified_base (364)..(364): a, c, t, g, unknown or other
  modified_base (376)..(376): a, c, t, g, unknown or other
  modified_base (408)..(408): a, c, t, g, unknown or other
  modified_base (421)..(421): a, c, t, g, unknown or other
  modified_base (433)..(433): a, c, t, g, unknown or other
  modified_base (478)..(478): a, c, t, g, unknown or other
  modified_base (521)..(521): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccnccaggctccgaggggagggctggagtgggtgccgttnagagacacaactaacngtcgacacgnacaatacgccgngtctgtgaaaggcagattcaccatctacaagngatgattcagganaactcactttanctgacaaaatgaaacagcctagaacgaaccgagacacgggccctntattatgttgtcattagcttaggaatacaacgagtgactgttntcgg

SEQ ID NO: 426270 - DNA, 596 bp, Homo sapiens
  misc_feature: GZ8MTXP01EKTBY.3.17.B06.1.454.CMB.2.raw
  modified_base (255)..(255): a, c, t, g, unknown or other
  modified_base (300)..(300): a, c, t, g, unknown or other
  modified_base (375)..(375): a, c, t, g, unknown or other
  modified_base (388)..(388): a, c, t, g, unknown or other
  modified_base (456)..(456): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagctctcctgtgcagcctntggactcaccttcacgctcaatggcccatacgtggactgggtccnccgaggcctccgaggggaaggggctgggaggtggggttggccgtttctaagagacacaaactaacagtcacacgnaacaataaccgcncgtctgagaaaggcaagattccacctatctacaaagtgattagattcaagacaaactctaacttttancgtagaactaaatcgaaacacgtcctaggaaacgaacccgacgaccgaccggtccttaattatttagtcgttagtactaagttacgacgttagaactaaccgaacggtacgggttacggttaccgtggttaacgttcggg

SEQ ID NO: 426271 - DNA, 598 bp, Homo sapiens
  misc_feature: GZ8MTXP01BD1R2.3.17.B06.1.454.CMB.2.raw
  modified_base (301)..(301): a, c, t, g, unknown or other
  modified_base (340)..(340): a, c, t, g, unknown or other
  modified_base (355)..(355): a, c, t, g, unknown or other
  modified_base (365)..(365): a, c, t, g, unknown or other
  modified_base (377)..(377): a, c, t, g, unknown or other
  modified_base (381)..(381): a, c, t, g, unknown or other
  modified_base (441)..(441): a, c, t, g, unknown or other
  modified_base (465)..(465): a, c, t, g, unknown or other
  modified_base (507)..(507): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggagcttggtccagcctggagggtccctaagactctcctgtgcagcctctggactcaccttcacgctcaatggcccactacgtggactggggtccnccaggctccgaggggaggctgggagtgggttgccgtttnagagacacaactacngtcgacacgnacataccgccgngtcngagaaggcagattcacccatccacaagacatagatttcaagagaaacttctaacttttancctagaacctaaaatcggaaaccnggaccctaggaaacgaaccccggaacgaccgacggtcccgtnttaagttattcggttgtccaagttaacgttcccttaagggtaactaaccgaacggaccggggttgttaacccgttgggttaacgttcgggg

SEQ ID NO: 426272 - DNA, 582 bp, Homo sapiens
  misc_feature: GZ8MTXP01ECR1N.3.17.B06.1.454.CMB.2.raw
  modified_base (387)..(387): a, c, t, g, unknown or other
  modified_base (447)..(447): a, c, t, g, unknown or other
  modified_base (464)..(464): a, c, t, g, unknown or other
  modified_base (510)..(510): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggtgggtccctaagactctcctgtgcagcctctggactcaccttcacgctcaatcggccacgtacgtggactgggtccgccaggctccgaggggagggctgggagtgggttggccgttcgtagagacacaactaacagtcgacacgcaacaataaccgccgngtctgtagaaagcagattcaccatctacaagagatagattcagaagaactctaactttanactagacaaatgaaacngcctgaaacgaaccgacgacgaccggtccgtaactattattggttntactaattacgaccttaggaacttaacgaacggtacgggttaggttaacccgttgggttaacgtttccgggg

SEQ ID NO: 426273 - DNA, 604 bp, Homo sapiens
  misc_feature: GZ8MTXP01AYGKL.3.17.B06.1.454.CMB.2.raw
  modified_base (255)..(255): a, c, t, g, unknown or other
  modified_base (300)..(300): a, c, t, g, unknown or other
  modified_base (371)..(371): a, c, t, g, unknown or other
  modified_base (386)..(386): a, c, t, g, unknown or other
  modified_base (443)..(443): a, c, t, g, unknown or other
  modified_base (490)..(490): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctntggactcaccttcacgctcaatggcccactacgtggactgggccnccaggctccgaggggagggctgggagtgggttcggccgtttctagacgacacaaactacagtcgacaccgnacaagtaaccgccgngtctgcgaaaggcaggacttccacatctacgaagagattaggattacgaacggtaanaaaccttctaacgttttaactccttaggaccaaaattcggaaaaccncgtaccgtaggaaccgaacccgacgtaccgaccggtcgttaacttagttgttcgttgtactaattacgacgttaggaactacgaacggtaggtacgttacgttggttcgtcggg

SEQ ID NO: 426274 - DNA, 557 bp, Homo sapiens
  misc_feature: GZ8MTXP01B6I4I.3.17.B06.1.454.CMB.2.raw
  modified_base (266)..(266): a, c, t, g, unknown or other
  modified_base (314)..(314): a, c, t, g, unknown or other
  modified_base (346)..(346): a, c, t, g, unknown or other
  modified_base (349)..(349): a, c, t, g, unknown or other
  modified_base (360)..(360): a, c, t, g, unknown or other
  modified_base (371)..(371): a, c, t, g, unknown or other
  modified_base (422)..(422): a, c, t, g, unknown or other
  modified_base (453)..(453): a, c, t, g, unknown or other
  modified_base (472)..(472): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgttgggttttccttgttgttatttacaaggtgtccagtgtgaggtgcaccgtggtggagtcgtggggggaggcttggtccagcctgggagggtcccctaagctctcctgtgcagcctntggactcaccttcacgctcaatggccaactacggtggactgggtcccncaggctcgagggagggctggagtgggtgcttnagngacacaactangtgacaaccgnaacgaataccgccgcgtctggagaaaggcagacttcaccatctacaaaganatgacttcgaagacgtaaactctaattttancctagaacaaatcgaaacncgtcagaacgacgaacgacgccggtcttagttattgttgttcactaagtacgtaactaggacttaacgtaacgggttcggttaag

SEQ ID NO: 426275 - DNA, 598 bp, Homo sapiens
  misc_feature: GZ8MTXP01DM88Q.3.17.B06.1.454.CMB.2.raw
  modified_base (263)..(263): a, c, t, g, unknown or other
  modified_base (473)..(473): a, c, t, g, unknown or other
  modified_base (490)..(490): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctggagggtccctaagactctcctgtgcagccctntggactcaccttcacgctcaatcggccactacgtggactgggtcccgccaggctccgagggggaagggggctgggacggttgggggtcggccgttctagacgacaacaactaacagtgaccaaccgcaacaataccgcccgcgtctggtagaaaggcagattcaaccatctacaagagatgaattcaagacgaacttactaacttttaanctagacaaatgaaaacngtcctaggaacgaaacccggaacgaacaccgggtccttactaagtttagttcgttgttaccaagtaacgaaccgtaagggacttaacgtaacggttcgggttaacggg

SEQ ID NO: 426276 - DNA, 564 bp, Homo sapiens
  misc_feature: GZ8MTXP01EWZJS.3.17.B06.1.454.CMB.2.raw
  modified_base (250)..(250): a, c, t, g, unknown or other
  modified_base (262)..(262): a, c, t, g, unknown or other
  modified_base (294)..(294): a, c, t, g, unknown or other
  modified_base (422)..(422): a, c, t, g, unknown or other
  modified_base (433)..(433): a, c, t, g, unknown or other
  modified_base (450)..(450): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagcgtgggtttctgttgttatttacaaggtgtccagtgtgaggtgcacctggtggagtcgtgggggagcttggtccagcctggaggtccctaagctctcctgtgcagcctcnggactcaccttnacgctcaatggccactacgtggactgggtccncaggctccgaggggagggctggagtgggttgccgttcagagacacaactaacagtcgacacgcaacaataacgcccgcgtctggtagaaaggcaagactttcaccatctacaagagatgattcagaanactctacttanctagacaaatgaaaccngcctaagaacgaaaccgacgacgtaccggctaacttaattagttgttcgtactaagttaacgaccttaaggaactacgaaacggtcgggtacggttaccttgggttaacgtcgg

SEQ ID NO: 426277 - DNA, 682 bp, Homo sapiens
  misc_feature: GZ8MTXP01AFE4C.3.17.B06.1.454.CMB.2.raw
  modified_base (343)..(343): a, c, t, g, unknown or other
  modified_base (479)..(479): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggccactacgtggactgggtccgcaggcctccgaggggaagggctggagtgggttggccgtttnagagacaacaaactaacgagtcgaccacgacaacaataaccggcccgcgttctaggtaggaaaagggccaaggactttaccaaccctatcctacaaagagataggatttacgaagaagaaaccttcaactttttanaccttaggaactaaaattaggaaacccagtccctaaggaacgaaaccccgacggtaacccgaaccggggtcccttaacttaactttaagttgggttacgttacctaagttacggttaacccgttaaaggggaacctttaaccggaaaaccggttaccgggggttacgggttacccgttaaggggttaaccgttttcccggggg

SEQ ID NO: 426278 - DNA, 557 bp, Homo sapiens
  misc_feature: GZ8MTXP01DLGN8.3.17.B06.1.454.CMB.2.raw
  modified_base (273)..(273): a, c, t, g, unknown or other
  modified_base (305)..(305): a, c, t, g, unknown or other
  modified_base (342)..(342): a, c, t, g, unknown or other
  modified_base (347)..(347): a, c, t, g, unknown or other
  modified_base (358)..(358): a, c, t, g, unknown or other
  modified_base (499)..(499): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtggggggaggcttgggtccagcctgggagggtccctaagactctcctgtgcagcctctggactcaccttnacgctcaatggccactacgtggactgggtccnccaggctccgaggggaggctggagtgggtggccgttnagganacacaactacngtcgaccacgcaacaataccgccgcgtctagagaaaggcaagacttcacatctacaaagagatagattcaagagaaactcaactttatcttagacaaaatgaaacagcctagaacgaaccgacgacacggcgtctaagttnttgttgtacattacgcttaggaataacgaacgtacggtgttacctggttaacttcggg

SEQ ID NO: 426279 - DNA, 581 bp, Homo sapiens
  misc_feature: GZ8MTXP01AKX1M.3.17.B06.1.454.CMB.2.raw
  modified_base (304)..(304): a, c, t, g, unknown or other
  modified_base (420)..(420): a, c, t, g, unknown or other
  modified_base (452)..(452): a, c, t, g, unknown or other
  modified_base (471)..(471): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatcggccactacggtggactggggtcccnccgaggcctccgagggggaaggggctgggaggttgggtggccgttctaggagacacaactaacagtcgacacgcaacaagtaacgccgcgtctgagaaaggcagacttcaccatcnaagagatagattacagagaacctctactttancgtagacaaatcgaaaacncgaccgtagaacgaccgacgacgaccggtcctaattattgtgttcgtactaagttacgttacgttaggtaactacgaacggtacgggtcggttacgtggttaacgtcggg

SEQ ID NO: 426280 - DNA, 553 bp, Homo sapiens
  misc_feature: GZ8MTXP01AE1DD.3.17.B06.1.454.CMB.2.raw
  modified_base (303)..(303): a, c, t, g, unknown or other
  modified_base (340)..(340): a, c, t, g, unknown or other
  modified_base (368)..(368): a, c, t, g, unknown or other
  modified_base (420)..(420): a, c, t, g, unknown or other
  modified_base (431)..(431): a, c, t, g, unknown or other
  modified_base (442)..(442): a, c, t, g, unknown or other
  modified_base (458)..(458): a, c, t, g, unknown or other
  modified_base (473)..(473): a, c, t, g, unknown or other
  modified_base (477)..(477): a, c, t, g, unknown or other
  modified_base (484)..(484): a, c, t, g, unknown or other
  modified_base (495)..(495): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatcggccacgtacgtggactgggtcccncaggctccgaggggagggctggagtgggttgccgttnagagacacaactaacagtcgaccaccgnaacaataaccgccgcgtctggtagaaaggcaagacttccacatctacaaganatgattcaganactcactttancgtagacaaatgaacngcctagacgaaccgngacncggtctntagttacttgngtcaattacgacttaggaataacgaacggtacggtggttaacctggttaagttccggg

SEQ ID NO: 426281 - DNA, 640 bp, Homo sapiens
  misc_feature: GZ8MTXP01BPLCC.3.17.B06.1.454.CMB.2.raw
  modified_base (304)..(304): a, c, t, g, unknown or other
  modified_base (344)..(344): a, c, t, g, unknown or other
  modified_base (474)..(474): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggaggtcttggtccagcctgggagggtccctaagactctcctgtgcagcctctggactcaccttcacgctcaatggccactcggtggactgggtccnccaggcctccgaggggagggctgggagtgggttcgcgttnagagacacaaactaacagtcgaacaccgcaacaataaccgccgcgtctgggtagaaaggcaagtacttcacatccagaagagatgattcgaagataactctactttagcttagaactaaatacggaaacngtacccgtagaaaccggaaacccgacgaccgtaaccggtcccgttaactttaaacgtttagttcggttcgttactaagttaaccggttacccgttaaagggaacgttaaacccgaacgggtccgggggttaggttacccgttaaggggtttaacgtttcccggggg

SEQ ID NO: 426282 - DNA, 705 bp, Homo sapiens
  misc_feature: GZ8MTXP01EZRQW.3.17.B06.1.454.CMB.2.raw
  modified_base (317)..(317): a, c, t, g, unknown or other
  modified_base (523)..(523): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttgggtccagcctgggacgggtccctaagctctcctgtgcagcctctggactcaccttcacgctacaatcggacccatacggtggactcggggtcccnccgaggcctaccggagggggaacgggggtctagggggagggttgggggtttcggccgtttacaggacgacaaccaaactaacagtagacccaaccgacaacgaaatacccggccgtcgtctaggtagaaaacggcaagtacttcaacctattcaacgaaaggagtataggaacttacgaaagtaactaacttcttaaactttttanccgttaagaacctaaaattcggaaaacctcgtaccctaggaaaccgaaaccccggaaggtacccggaaaccggggtccctttaaacgttattttaacgttgggttacttaaccgtaagtaaacggtaacccgttaaagggtaaccttaaccggtaaaccggggttaacggggtttaaccggg

SEQ ID NO: 426283 - DNA, 638 bp, Homo sapiens
  misc_feature: GZ8MTXP01EPU0A.3.17.B06.1.454.CMB.2.raw
  modified_base (267)..(267): a, c, t, g, unknown or other
  modified_base (299)..(299): a, c, t, g, unknown or other
  modified_base (336)..(336): a, c, t, g, unknown or other
  modified_base (351)..(351): a, c, t, g, unknown or other
  modified_base (360)..(360): a, c, t, g, unknown or other
  modified_base (373)..(373): a, c, t, g, unknown or other
  modified_base (429)..(429): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctctggactcaccttnacgctcaatggccactacgtggactgggtccncaggctccgaggggagggctggagtgggttgccgttnagagacacaactacngtcacacgnacaataacgccgngtctgtagaaaggcaagacttcaccatctacgaagagtatagtattacgaaggtanaaaccttctaacttttactaccttggaaccaaaattcggaaactacggaccctagggaaaccgaaaccccgaggtaaacccgaccggggccttaacttaagtttaacttgggttacgttacaaagttaccggaccctttaaggggaacttaacccggaaaacgggtccggggttacggttacccgttaaggggttaacgtttccggggg

SEQ ID NO: 426284 - DNA, 575 bp, Homo sapiens
  misc_feature: GZ8MTXP01CDABW.3.17.B06.1.454.CMB.2.raw
  modified_base (302)..(302): a, c, t, g, unknown or other
  modified_base (321)..(321): a, c, t, g, unknown or other
  modified_base (338)..(338): a, c, t, g, unknown or other
  modified_base (342)..(342): a, c, t, g, unknown or other
  modified_base (352)..(352): a, c, t, g, unknown or other
  modified_base (362)..(362): a, c, t, g, unknown or other
  modified_base (375)..(375): a, c, t, g, unknown or other
  modified_base (409)..(409): a, c, t, g, unknown or other
  modified_base (465)..(465): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctctggactcaccttcacgctcaatcggcccatacggtgactgggtccnccaggctcgaggggaggcngggagtgggtgccgttnaganacacaactanagtcacacgnaacaataccgccngtctgtagaaagcagattccactatcacaaaganatagtaattcgaaggactaaactctaacttttatccgtagtacctaaatcgaaacncgcctagaacgaaccgtacgacgaccggtccgtaacttagttattggacgtacaagttacgacttaggaataaccgaacggtacggtgttaccgtgggttaacttcgggg

SEQ ID NO: 426285 - DNA, 597 bp, Homo sapiens
  misc_feature: GZ8MTXP01DRJQ6.3.17.B06.1.454.CMB.2.raw
  modified_base (348)..(348): a, c, t, g, unknown or other
  modified_base (365)..(365): a, c, t, g, unknown or other
  modified_base (380)..(380): a, c, t, g, unknown or other
  modified_base (408)..(408): a, c, t, g, unknown or other
  modified_base (418)..(418): a, c, t, g, unknown or other
  modified_base (450)..(450): a, c, t, g, unknown or other
  modified_base (506)..(506): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgggaggtgcacctggtggagtcgtgggggagggcgttggtccagccgtggagggtccctaagactctcctgtgcagcctctggactcacccttcacgctcaatggccactacggtggactgggtccgccaggctccgagggaagggggctggaggtgggttggccgttntagagacacaactaacngtcgaccaccgacanaaactacgcccgctctgtagaaagcagnttcacatcanaagagatgtattcagacgaactcaacttttanccttggaacaaattcgaaacacgcctaggaacgaaaccgaccgacacgggcccttntaattattgtacgttctaagtacgttaaccttagggttaactaaccgaacggtaacggggttgtacccgttggttaacgttcggtcggggg

SEQ ID NO: 426286 - DNA, 590 bp, Homo sapiens
  misc_feature: GZ8MTXP01EOKYK.3.17.B06.1.454.CMB.2.raw
  modified_base (298)..(298): a, c, t, g, unknown or other
  modified_base (304)..(304): a, c, t, g, unknown or other
  modified_base (334)..(334): a, c, t, g, unknown or other
  modified_base (499)..(499): a, c, t, g, unknown or other
  modified_base (515)..(515): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggaggcttggtccagcctggagggtccctaagctctcctgtgcagcctctggactcaccttcacgctcaatggccatacgtggactgggtccncaggcncgaggggagggctggagtgggttgccgttnagagacacaactaacagtcgaacacgcacgaataaccgccgcgtctggtagaaaaggcaaggtacttccaacctatctacaagagatagattcaagagaactctaactttatcgttagaacaaaatgaaacagcctagaaacgaaacccgagaaccacggccgtnttaactttattggttntacgaattacgacccgttaaggtaactaaccgaaacggtacgggttcgttaccgttgggttaacgtttccggggg

SEQ ID NO: 426287 - DNA, 565 bp, Homo sapiens
  misc_feature: GZ8MTXP01ATZNP.3.17.B06.1.454.CMB.2.raw
  modified_base (305)..(305): a, c, t, g, unknown or other
  modified_base (367)..(367): a, c, t, g, unknown or other
  modified_base (377)..(377): a, c, t, g, unknown or other
  modified_base (389)..(389): a, c, t, g, unknown or other
  modified_base (393)..(393): a, c, t, g, unknown or other
  modified_base (448)..(448): a, c, t, g, unknown or other
  modified_base (467)..(467): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccactacgtggactggggtccnccaggcctccgaggggaaggggctgggagtggggttggccgttcaggagacaacaactaacngtcgacacgnacaatacgccgngtcngtgaaaggcaagcttcaccatctacaagagatgattcaagagaactcaactttancgtagactaaatcgaaacngcctagacgaacccgacgtacacgggcctctaattatcgttgactattacgccttaggaactacgaacggtacggtgttacctgggttaacgttcggg

SEQ ID NO: 426288 - DNA, 606 bp, Homo sapiens
  misc_feature: GZ8MTXP01C1Q0B.3.17.B06.1.454.CMB.2.raw
  modified_base (255)..(255): a, c, t, g, unknown or other
  modified_base (299)..(299): a, c, t, g, unknown or other
  modified_base (372)..(372): a, c, t, g, unknown or other
  modified_base (464)..(464): a, c, t, g, unknown or other
  modified_base (485)..(485): a, c, t, g, unknown or other
  modified_base (525)..(525): a, c, t, g, unknown or other
  modified_base (538)..(538): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctggagggtccctaagctctcctgtgcagcctnggactcaccttcacgctcaatggccactcgtggactgggtcccnccgaggcctcggaggggaacgggctgggagtggggttgccgtttcagagacacaactacagtcgaacaccganaacaataccgccgcgtctaggtagaaacggcagtacttcaacctatcctacgaaagagattgaattcgaaggacaaacttctaaacttttancttagaactaaaatcgaaacncgcctaggaaacgaaacccgtacgaccgtaccggtccgtnttaattagttcgngtacaagttacgaccgttaaggaactaaacgaacggtacgggtagttaccgttggttaacgttcgggg

SEQ ID NO: 426289 - DNA, 555 bp, Homo sapiens
  misc_feature: GZ8MTXP01DJBS7.3.17.B06.1.454.CMB.2.raw
  modified_base (259)..(259): a, c, t, g, unknown or other
  modified_base (306)..(306): a, c, t, g, unknown or other
  modified_base (346)..(346): a, c, t, g, unknown or other
  modified_base (354)..(354): a, c, t, g, unknown or other
  modified_base (362)..(362): a, c, t, g, unknown or other
  modified_base (372)..(372): a, c, t, g, unknown or other
  modified_base (383)..(383): a, c, t, g, unknown or other
  modified_base (400)..(400): a, c, t, g, unknown or other
  modified_base (411)..(411): a, c, t, g, unknown or other
  modified_base (417)..(417): a, c, t, g, unknown or other
  modified_base (429)..(429): a, c, t, g, unknown or other
  modified_base (441)..(441): a, c, t, g, unknown or other
  modified_base (453)..(453): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggagtcgtggggggagcttggccaggcctgggagggtccctaaagctctcctgtgcagcctntggactcaccttcacgctcaatggccacgtacgtggactgggtcccnccaggctccgaggggagggctgggagtgggttgccgtttnagagacanaactaacngtcaccacanacaatacgccngtctgagaaaggcaagnttcacatctanaagagntagattcaaganaactcactttancgtagaacaaanacgaacagcagaaccgaaccgacgacgacgtctaattattatgttagtacaattacgacgttaagaataacgaacggtcggtacgttacgtggttcgtcggg

SEQ ID NO: 426290 - DNA, 562 bp, Homo sapiens
  misc_feature: GZ8MTXP01DNU5X.3.17.B06.1.454.CMB.2.raw
  modified_base (261)..(261): a, c, t, g, unknown or other
  modified_base (374)..(374): a, c, t, g, unknown or other
  modified_base (480)..(480): a, c, t, g, unknown or other
  modified_base (512)..(512): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctggagggtccctaagctctcctgtgcagcctntggactcaccttcacgctcaatcggccactacggtggactggggtcccgccgaggctccgagggggaagggggctgggaggttggggtggccgttcagagacaccaactaacngtgacaaccgcaacaaatccgccgcgtctgtagaaaggcagattcaccatctacaagagatgattcaagacgaactactacttttatcttagactaaatcgaaacngtcctagaacgaaccgaacgacacgggccttntattattgttgttcaatagaacctaggacttacgaacgttcgggttaacg

SEQ ID NO: 426291 - DNA, 565 bp, Homo sapiens
  misc_feature: GZ8MTXP01CJGEC.3.17.B06.1.454.CMB.2.raw
  modified_base (303)..(303): a, c, t, g, unknown or other
  modified_base (342)..(342): a, c, t, g, unknown or other
  modified_base (452)..(452): a, c, t, g, unknown or other
  modified_base (470)..(470): a, c, t, g, unknown or other
  modified_base (510)..(510): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactccaccttcacgctcaatcggccactacgtggactgggtccnccaggctccgaggggagggctgggagtgggtgccgtttnagagacacaactacagtcgacacgcaacaataaccgccgcgtctggtagaaaggcagtacttccaccatcctacaaagagatgaattacaagacgaacttctaattttanctagactaaatcgaaacngccctaggaacgaaccgcggacacggcctaatattattgngtacattacgacttaggaactaacgaacgtcggtgttaccgtggttaagttcggg

SEQ ID NO: 426292 - DNA, 781 bp, Homo sapiens
  misc_feature: GZ8MTXP01DDXP7.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgtttgtttattttacaaggtgtccagtgtgaggtgcacctgggtggagtcgtggggggaggcttgggtccagccgtgggacgggtcccctaagacctctcctgtgcagcctctggactccaccttcacgctcaatcggccacgtacggtggacgtcggggtcccgccgaggcctccggagggggaacggggcgtggggaggttgggggttcggccgtttacgtaaggacgacaaccgaaactaacgagtcgaccaccgcaaccaactaacccggccgcgttctagggtaggaaaacgggcaaggtacttcccaacctattacctacgaaaggaagtaataggtaatttacgaaaggtaacgtaaaaccttcttaaacctttttaactaccgttaacggaaacctaaaaaagttcgaaaaccacggtacccgtaggaaaacccggaaaccccggtaaccggaacccgtacccgggtaccccgtttaactttaaagtttacgttttgggttacgttaaacctaaggttaaaccggttaacccgttaaaggggtaaaccttaaaaccggaaaccgggttaccggggttacgggtttaacccgtttgggggttaacgttttcccgggggg

SEQ ID NO: 426293 - DNA, 616 bp, Homo sapiens
  misc_feature: GZ8MTXP01EODZM.3.17.B06.1.454.CMB.2.raw
  modified_base (256)..(256): a, c, t, g, unknown or other
  modified_base (269)..(269): a, c, t, g, unknown or other
  modified_base (301)..(301): a, c, t, g, unknown or other
  modified_base (341)..(341): a, c, t, g, unknown or other
  modified_base (358)..(358): a, c, t, g, unknown or other
  modified_base (369)..(369): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctntggactcaccttnacgctcaatggccactacgtggactgggtccnccaggctccgaggggaaggctggaggttgggtggccgttnaggagacacaactaacngtcgacaccgnacaactaccgccgcgtctagtagaaaggcaaggattccaaccatctacaaagagatagaattcaaggtaacaacctctaacttttactactagaaactaaatcggaaacacgtacccgtaggaaaccgaaacccgacggaaccaccggggtccctaattaagtttacttggttagtacaagttacgaccttaagggtaataaccaacgggtcgggttacggttaaccttgggtttaacgttccgggg

SEQ ID NO: 426294 - DNA, 588 bp, Homo sapiens
  misc_feature: GZ8MTXP01DX0LT.3.17.B06.1.454.CMB.2.raw
  modified_base (261)..(261): a, c, t, g, unknown or other
  modified_base (350)..(350): a, c, t, g, unknown or other
  modified_base (364)..(364): a, c, t, g, unknown or other
  modified_base (430)..(430): a, c, t, g, unknown or other
  modified_base (455)..(455): a, c, t, g, unknown or other
  modified_base (472)..(472): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctggagggtccctaagctctcctgtgcagcctnggactcaccttcacgctcaatcggaccactacggtggactgggtcccgccaggctccgaggggaaggggctgggagtgggttgccgttnagagacacaactanagtgacaaccgcaacgaaactacgcccgcgtactggtagaaaggcagattacacatactacaaganatgattcaagagaactctactttancctgacaaatgtaaacngtaccgtagaacgaaacccggaacgaacaccgggtccttactaaagtttcttggttcgttacaagttaaacgaaccgttaagggaacttaccgtaaaccgggttcggtttaacggg

SEQ ID NO: 426295 - DNA, 669 bp, Homo sapiens
  misc_feature: GZ8MTXP01BZMYG.3.17.B06.1.454.CMB.2.raw
  modified_base (263)..(263): a, c, t, g, unknown or other
  modified_base (395)..(395): a, c, t, g, unknown or other
  modified_base (522)..(522): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcacgtggtggagtcgtggggagcttggtccagccgtggacggtccctaagactctcctgtgcagcctntggactcaccttcacgctcaatcggcccacgtacggtggacgtcgggtcccgccgaggcctccggagggggaacggggtctaggggtaggttgggttcggtccgttgtaagacgacaaccgtaaactaacgngtacgaaccaacccgcaacgaaacgtacccggccgtcgtcgtaggtagaaaggcctaagtacttaccacctatcgtaacgaaggatattagaattacgaaggtaactaacctttactaactttttanacgtagaaactaaagtacgaacacgtaccgtaggaaccgaaaccgaacgtaaccgacggtaccttagttaagtttgttcggttcgttaacgtaacgtacgtaaccgtaaggtaaccgttaaccggtaacgggttaacgggttaacgg

SEQ ID NO: 426296 - DNA, 663 bp, Homo sapiens
  misc_feature: GZ8MTXP01DTB8Z.3.17.B06.1.454.CMB.2.raw
  modified_base (258)..(258): a, c, t, g, unknown or other
  modified_base (305)..(305): a, c, t, g, unknown or other
  modified_base (367)..(367): a, c, t, g, unknown or other
  modified_base (379)..(379): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcactgggtggagtcgtgggggagcttggtccagcctgggacgggtccctaagactctcctgtgcagcctntggactcaccttcacgctcaatcggccactacgtggactgggtcccncaggctccgagggggaagggctgggaggttggggttcggccgtttgagagacaacaaactanagtcgaccacgnaacaagtaccgcgcgtctagtagaaaggccagtactcctttacatactacaaagagaataggtaattacgaaggaactaaactaccttaacttttaactaccgtagtaactaaaatacgaaacagacccgtagaaaccgaaaccgtaaccgaaccgaccgggtaccttaacttaagttatttacgttacggtacctaagttaaacggaacccgttaagggaaacgttaacgaaaccgggtaacgggttacggttacccggttaagggtttaacgtttccggggg

SEQ ID NO: 426297 - DNA, 687 bp, Homo sapiens
  misc_feature: GZ8MTXP01EAUQJ.3.17.B06.1.454.CMB.2.raw
  modified_base (550)..(550): a, c, t, g, unknown or other
  modified_base (574)..(574): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacgtggtggagtcgtgggggagcttggtccagccgtggacgggtccctaagctctcctgtgcagcctctggactcaccttcacgctacaatcggacctaacgtacggtggacctggggtccccgccgaggcctacccggaagggggaacgggggtcttgggggaggtttgggggttcggtcccgtttacaaggacgaaccaaccaaaactaaacgaggtacgaacccaaccccggacaaccgaaagtacccggcccggtacgttcgtagggtaacggaaaagggcaagtacttacacctaatcctaacgaaagagtatagaacttacaaagtaacgtaaaccttctaacttttanacgtacgaacaaagtcgaaaaccncgtaccgtagaaccgaacccgaacgaccgaccggtaccttagttagtttagttgttcgttactaagtaacgtaaccgtaaggaaccgttaaccggtaacgggttcggttaacg

SEQ ID NO: 426298 - DNA, 842 bp, Homo sapiens
  misc_feature: GZ8MTXP01DAMCZ.3.17.B06.1.454.CMB.2.raw
  modified_base (318)..(318): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagtcttgggttttccttgttgttatttacaaggtgtcagtgtgaggtgcacgtgggtggagtcgtgggggagtcttggtccagccgtgggacgggtaccctaagactctcctgtgcagcctctggacctcaccttcacgtctacaatcggacccacgtacggtggacgtcggggtcccnccgaagggcctaccggaaggggggaacggggtctagggggaggttgggggtttcggccccgttttagaaaggaacgaaccaaactaaacgtaaaccgaggtaccgaaccgaaccggtacaaaccgtaaacgtaacccggccccggtgttaccgttagggtaaagggaaaaaacgggtccaaagggtaactttaccccgaaacccctaaagtttacctaaaccgaaaaggaacgtaaggttacggtaaattttaccgaaaagggaaacgttaaaacccttactaaacctttttaaagtacccggttaaggaaacccgtaaaaattaccgggaaaacctacggtaaccccgtaaggaaaaccccgggaaaaccccgtaacggttaaacccgacccggggtacccgtttaacttaaagtttacgtttaggttacggttaacctaagttaaccgaacccggttaaggaactaaaccggtaacgggtacgggtacggttaaccggttaaggtttaacggtttccggggg

SEQ ID NO: 426299 - DNA, 552 bp, Homo sapiens
  misc_feature: GZ8MTXP01CY3YM.3.17.B06.1.454.CMB.2.raw
  modified_base (301)..(301): a, c, t, g, unknown or other
  modified_base (339)..(339): a, c, t, g, unknown or other
  modified_base (365)..(365): a, c, t, g, unknown or other
  modified_base (440)..(440): a, c, t, g, unknown or other
  modified_base (457)..(457): a, c, t, g, unknown or other
  modified_base (496)..(496): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccnccaggctccgaggggagggctggagtgggtggccgttntagagacacaactacagtcgacacgnacaataccgccgcgtctgtagaaagcagattcaccatcctacaagagtatagattcaaggacaactcaactttancgtgactaaatgaaacngcctaggaacgaaccgacgacacgggcctctattattgngtacattacgaccttaggaactaacaacggacggtgttaccgtggttaacttcggg

SEQ ID NO: 426300 - DNA, 462 bp, Homo sapiens
  misc_feature: GZ8MTXP01CK3BD.3.17.B06.1.454.CMB.2.raw
  modified_base (351)..(351): a, c, t, g, unknown or other
  modified_base (362)..(362): a, c, t, g, unknown or other
  modified_base (434)..(434): a, c, t, g, unknown or other
  modified_base (450)..(462): a, c, t, g, unknown or other
tcagagacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctagatacaacgacggtgtacctggtattcgcggtgggtctacgtgggccagggaccctggtcaccgtctcctcagccctccaccaaggccccatccggtccttccccctggccgccctgctccaggacncacccctcgangcacaacgcgccctgggctgccctggtacaagggcctacttcccgagtcgcgtcctcgtgacggcgggtcgnggacgaaggcgacagnnnnnnnnnnnnn

SEQ ID NO: 426301 - DNA, 573 bp, Homo sapiens
  misc_feature: GZ8MTXP01BIVEG.3.17.B06.1.454.CMB.2.raw
  modified_base (257)..(257): a, c, t, g, unknown or other
  modified_base (305)..(305): a, c, t, g, unknown or other
  modified_base (362)..(362): a, c, t, g, unknown or other
  modified_base (370)..(370): a, c, t, g, unknown or other
  modified_base (374)..(374): a, c, t, g, unknown or other
  modified_base (459)..(459): a, c, t, g, unknown or other
  modified_base (477)..(477): a, c, t, g, unknown or other
  modified_base (509)..(509): a, c, t, g, unknown or other
  modified_base (515)..(515): a, c, t, g, unknown or other
  modified_base (524)..(524): a, c, t, g, unknown or other
  modified_base (545)..(545): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagccgtggagggtccctaagactctcctgtgcagcctntggactccaccttcacgctcaatcggccactacggtggactgggtccnccaggcctccgaggggaggggctggggagtgggttcgccgttcagagacacaactanagtcgacncganacaatacccgcgcgtctggtagaaaggcagtacttccaccattccacaaagagattagatttacgagaacgactctaacttttancgtagacaaaatcgaacngcctaggaacgaaccgacgacgccggccgttntaattntggttctanagttacgccttaggaatacgnggtacggtgttacctggttaacttcggg

SEQ ID NO: 426302 - DNA, 676 bp, Homo sapiens
  misc_feature: GZ8MTXP01AEV7J.3.17.B06.1.454.CMB.2.raw
  modified_base (299)..(299): a, c, t, g, unknown or other
  modified_base (311)..(311): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagccgtggacgggtccctaagactctcctgtgcagcctctggactcaccttcacgctcaatcggccactacgnggactgggcccncgaggcctacggaggggacgggcgtgggtagggttggggttcggtccgtttacgaggacgtaaccaaccgtaaactacgaggtacgaaccgaacccgacaacgaacgtacccgaccgtcgtacgtaggtaacggaaaacggcaagtaacttaccaacctactacgtaaccgaaaggacgtagtacgtacttaacgaagtaactaacttacttaactttacgtactacgaataaacgtacggaaacacgtaccgtaaggaaccgaaacccgaacgaccggaccggtcccgttattaagttttacttcgggttcttactaagtacgtaacgtaaggacttaacgtaacggttaacgggtttaaccgg

SEQ ID NO: 426303 - DNA, 622 bp, Homo sapiens
  misc_feature: GZ8MTXP01CBMC0.3.17.B06.1.454.CMB.2.raw
  modified_base (314)..(314): a, c, t, g, unknown or other
  modified_base (360)..(360): a, c, t, g, unknown or other
  modified_base (508)..(508): a, c, t, g, unknown or other
  modified_base (530)..(530): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagcctggacggtccctaagactctcctgtgcagcctctggactcaccttcacgctacaatcggaccacgtacgtggactcgggtcccncgacggctccgaagggggagggctgggagttggggttcgccgtttnagagacaaccaactaacgagtacgaaccaacccgacaacgaaacgtacccggcccgtacgtcgtaggtaaggaaaaggccaagtacttccaacctatctaacgaaagagtatacgattacgaagacgtaacttctaacgtttttaacncgtaagaactaaatacgaaacncgtaccgtagaaccgaacccgaacgacgttaccggtcttacttattcgttgcttacaatacgtaactaggacttacgaacggttcggtaacg

SEQ ID NO: 426304 - DNA, 636 bp, Homo sapiens
  misc_feature: GZ8MTXP01DIQ15.3.17.B06.1.454.CMB.2.raw
  modified_base (304)..(304): a, c, t, g, unknown or other
  modified_base (365)..(365): a, c, t, g, unknown or other
  modified_base (424)..(424): a, c, t, g, unknown or other
  modified_base (461)..(461): a, c, t, g, unknown or other
  modified_base (482)..(482): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggagcttggtccagcctgggacgggtccctaagactctcctgtgcagcctctggactcaccttcacgctcaatggccactacggtggactgggtccnccaggctaccgaggggaggggctggggagttgggggttgccgtttcgagagacacaactanagtcgacaccgcaacaactaaccgccgtcgtctggtaagaaaggcagactcaacatcanaagagatagattcaagtacgaacttctaacttttacncgtagaactaaaatcgaaacncgtccgtaggaaacgaaccgtacgaaccgccggtccgtaactttagtttactttggacgttactaagttaacggttaacccgttaagggtaaaccttaaacggaaaccgggttacgggttacggttaacccgttggggttaacgtttccggggg

SEQ ID NO: 426305 - DNA, 763 bp, Homo sapiens
  misc_feature: GZ8MTXP01APPVG.3.17.B06.1.454.CMB.2.raw
  modified_base (320)..(320): a, c, t, g, unknown or other
  modified_base (588)..(588): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagccgtggacgggtccctaagcctctcctgtgcagcctctggactccaccttcacgctacaatcggaccctaacgtacggtgggaccgttcggggtccccnccgagggcctacccggaaggggggaacggggctgggggtaggttggggggttcggcccggtttacgtaaggaacggaccaaaccaaacttaaacgaggttaaccggaccaaccggcaaacgaaactaaccggcccgtcgtctagggtaagaaacggcaaggtactttaccgaacctatacctacgaaagagtaatacgaatttaccgaaaggtaacaaaccttcctaactttttacaccgttaaggaaccttaaaagtcggaaaaccnccggtaccgtaacggaaaccggaaacccggtaaccggaaccgtaaccgggtcccttaactttaacgtttagttcggttaacgtaccgtaaagttaaccggttaaccgttaagggtaaactaaaccgggaaccgggttacgggttacgggttaccgttaagggttcggttccgggg

SEQ ID NO: 426306 - DNA, 602 bp, Homo sapiens
  misc_feature: GZ8MTXP01CMJU6.3.17.B06.1.454.CMB.2.raw
  modified_base (303)..(303): a, c, t, g, unknown or other
  modified_base (339)..(339): a, c, t, g, unknown or other
  modified_base (342)..(342): a, c, t, g, unknown or other
  modified_base (363)..(363): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtggggggagcttggtccagcctgggagggtccctaagactctcctgtgcagcctctggactcaccttcacgctcaatcggccatacgtggactgggtccnccaggctccgaggggagggctgggagtgggtgcgtnagngacacaatacagtcgacacgnacaatacgccgcgtctaggtgaaaaggcaaggtacttaccacctatcctacaaagagattagaatttccaggaacaacttctaaactttatctaggtaacctaaaatacggaaacacgtccctaggaaacggaaacccgacgaaccgtaccgggtccgtaacttaagtttattcgagttaccaagttacgaccttagggaactaacgaacgacgggtgttacctggttaagtttccggg

SEQ ID NO: 426307 - DNA, 707 bp, Homo sapiens
  misc_feature: GZ8MTXP01BD3BQ.3.17.B06.1.454.CMB.2.raw
  modified_base (311)..(311): a, c, t, g, unknown or other
  modified_base (511)..(511): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggaggcttggtccagcctgggagggtccctaagactctcctgtgcagcctctggacctccaccttcacgctcaatcggccactacggtggactcggggtcccnccgaggcctccggagggggaacggggctggggaggttgggggttcggtcccgtttacgtaaggacgaccaacgtaaactaacgaggtaccgaaccaccgacaaccaagtaacccgcccgcgtctaggtagaaacgggcaagtacttccaccatcctacaaaggagatacgatttcgaaggtacaacttctaatttttacncgtaacgtaactaaagtacgaaaccacgtacctaaggaaaccggaaacccggaccgaaccggtacccgggtccttaactttaagtttagttcggttacgtaacgtaacgttaaccggttaaccgttaaggtaactaaccggtaaaccggggttacggggttacggttaacccgtttggggtttaacggttccgggg

SEQ ID NO: 426308 - DNA, 726 bp, Homo sapiens
  misc_feature: GZ8MTXP01AR8IG.3.17.B06.1.454.CMB.2.raw
  modified_base (267)..(267): a, c, t, g, unknown or other
  modified_base (297)..(297): a, c, t, g, unknown or other
  modified_base (335)..(335): a, c, t, g, unknown or other
  modified_base (350)..(350): a, c, t, g, unknown or other
  modified_base (393)..(393): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttccttgttgttattttacaaggtgtccagtgtgaggtgcacctggtggagtcgtgggggagcttggtccagcctggaggtccctaagctctcctgtgcagcctctggactcaccttnacgctcaatggccactagtggactgggccncaggctccgaggggagggctggagtgggttcgccgttnagagacacaactaanagtcgacacgcaacactaaccgccgcgtctaggtagaaacggnaacgtacttccaaccctataccctacgaaaaggagtaagttagtaacttacgaaacgtaaacgtaaaccttaccttaacttttaacgtacggttaacgaaacgttaaaagtacggaaacctacggtacccgtaaagggaaacccgggaaacccggtaaccggtaaacccgtaacccggggttacccgtttaactttaaacgttttaggtttacggttaacgttaacctaaacggttaaaccggttaccgttaaacgggtaaccttaaaccggtaaaccggggttaccgggtttacgggtttaaccgttaacgggggttttaacgttcccgggg

SEQ ID NO: 426309 - DNA, 646 bp, Homo sapiens
  misc_feature: GZ8MTXP01BETLB.3.17.B06.1.454.CMB.2.raw
  modified_base (518)..(518): a, c, t, g, unknown or other
  modified_base (542)..(542): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttatttacaaggtgtccagtgtgaggtgcacctggtggagtcgtgggggagcttggtccagcctgggacgggtccctaagctctcctgtgcagcctctggactcacccttcacgctcaatcggacccacgtacggtggactcggggtcccgccaggcctaccgagggggagggggctgggaggttggggttgccgttgagacgacccacaaactaacagtcgaaaccacccgcaacaaacgtaccggccgtccccgttagtaggtacgaaaaggtcaaaggtacttaccaacctattacctacgaaaagaggtaatgaactttacgaaggaacgtaaaccttctaacttttacncctagacctaaaagtcggaaaacncggtaccctaggaacggaaacccgcggaccaccggggttccgtacttaattagttgttacgtaactaagtaacgaaccgtaggaactaaccgaacggtaacggg

SEQ ID NO: 426310 - DNA, 570 bp, Homo sapiens
  misc_feature: GZ8MTXP01ECCV5.3.17.B06.1.454.CMB.2.raw
  modified_base (255)..(255): a, c, t, g, unknown or other
  modified_base (302)..(302): a, c, t, g, unknown or other
  modified_base (405)..(405): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggaggcttggtccagcctgggaggtccctaagactctcctgtgcagcctntggactccaccttcacgctcaatggccactacgtggactgggtcccncgaggctccgaggggagggctgggagtgggttgccgttctagagacacaactaacagtcgaccacgcacaataccgcgtcgtctgtagaaggcagattcaccntacacaagagatagattacaggacaaactctaactttatcgtagaacaaatgaaacagcctagaacgaaccgacgacacggcctaattattagtgttcgactagttacgccttagggaacttaaacgaacgggtacggtcggttaccttgggttaacgttcgggg

SEQ ID NO: 426311 - DNA, 724 bp, Homo sapiens
  misc_feature: GZ8MTXP01AWZXE.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagtcttgggttttccttgttgttattttacaaggtgtccagtgtgaggtgcaccgtggtggagtcgtgggggagtcttggccagccgtggacgggtccctaagctctcctgtgcagcctctggactctaccttcacgctcaatcggcccacgtacgtggacgtcgggtccccgcgacggcctccggagggggaacggggcgtggggaggttgggggttcggtcccgtttacgtaaggacgaacctaaccaaacgtaaacgagtcccgaaccaccgacaaactaactaacccggccgcgtactaggtaggaaacggctaagtacttacacctatacctacgaagagattagacttacgaagtaacgacttctaaacttttacaccggtataaacctaaattacggaaacctacggaccgtaggaaaccgaaacccggaccgaaccgtaccgggtcccttaacttaacgttttagtggttacgttaacgtaacgttaacggttaacccgttaagggtaaccttaaacccgggaaacgggttccgggttaagggttaccccgtttaaggggtttaaccgtttcggggg

SEQ ID NO: 426312 - DNA, 689 bp, Homo sapiens
  misc_feature: GZ8MTXP01CWOQ8.3.17.B06.1.454.CMB.2.raw
  modified_base (326)..(326): a, c, t, g, unknown or other
  modified_base (545)..(545): a, c, t, g, unknown or other
  modified_base (551)..(551): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagtcgttgggttttccttgttgttattttacaaggtgtcagtgtgaggtgcacctggtggagtcgtgggggagtcttggtccagccgtgggacggtccctaagactctcctgtgcagcctctggacctcaccttcacgctcaagtcggaccctaacgtacggtggacgttcggggtccccnccgacggcctacccggagggggaagggggtcgtgggaggtttgggggtcggaccgtttcgtaaggagaaccaaaccctaaaacgtaacgagtacgaacccaaacccgacaaccaaagtaccggcccgtcgtacgtaggaaggaaaacggcaagtacttaccaaccattccctaagaaagagaatagaattacgaagtaactaaacttctaaacttttanacgtanaaacaaatacgaaactacgtaccgtaacgaaaccgaaaccggaacgaaccgttaccggtacttacgttagttagttacgttcgttactaacgtaacgaacgtaaggtacttaacggtaaccgggttaacgggttaacg

SEQ ID NO: 426313 - DNA, 630 bp, Homo sapiens
  misc_feature: GZ8MTXP01A4QSM.3.17.B06.1.454.CMB.2.raw
  modified_base (256)..(256): a, c, t, g, unknown or other
  modified_base (279)..(279): a, c, t, g, unknown or other
  modified_base (290)..(290): a, c, t, g, unknown or other
  modified_base (300)..(300): a, c, t, g, unknown or other
  modified_base (343)..(343): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtgcagtgtgaggtgcacctggtggagtcgtgggggaggcttggtccagccgtggagggtcctaagactctcctgtgcagcctntcggactcaccttcacgctcaanggccactacgnggactggccncaggcctccgagggagggctgggaggtgggttggcccgtttanaggagacacaaacgtaacagtcgacacccgacacaaactaccgcccgacgtctaggtacgaaaggccaagtacttccacactctacaagagatgattcgaagtaacactactatttacgctagacctaaatcgaaaccaggtcccctaagggaacccgaaaccccgggtaaacgacccggaccggtaacccgttacgttactttaagttcgtaagtccttaagttaccgacccgttaagggacttaaccgaacggtacggttacggttaaccgttgggtttaaccgg

SEQ ID NO: 426314 - DNA, 557 bp, Homo sapiens
  misc_feature: GZ8MTXP01AWCVS.3.17.B06.1.454.CMB.2.raw
  modified_base (173)..(173): a, c, t, g, unknown or other
  modified_base (301)..(301): a, c, t, g, unknown or other
  modified_base (335)..(335): a, c, t, g, unknown or other
  modified_base (361)..(361): a, c, t, g, unknown or other
  modified_base (377)..(377): a, c, t, g, unknown or other
  modified_base (416)..(416): a, c, t, g, unknown or other
  modified_base (427)..(427): a, c, t, g, unknown or other
  modified_base (439)..(439): a, c, t, g, unknown or other
  modified_base (457)..(457): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtntacagtgtgaggtgcacctggtggagtcgtgggggagcttggtccaggcctgggagggtccctaagctctcctgtgcagcctctggactcaccttcacgctcaatggccactacgtggactgggtccnccaggctcgaggggaggctggagtgggtgccgtnagagacacaactacagtcgaccacgnaacaataaccgcccgngtctgtagaaacggcaagacttccaccattccacaaganatgattcaganaactcactttancgtagaacaaatagaacngactagaaccgaccgacgacgccggtacctaattattgtgttcgtactaattacgacttagaactaacgaacggtacggtcggttacgttggttcgtcgg

SEQ ID NO: 426315 - DNA, 600 bp, Homo sapiens
  misc_feature: GZ8MTXP01A23LB.3.17.B06.1.454.CMB.2.raw
  modified_base (300)..(300): a, c, t, g, unknown or other
  modified_base (370)..(370): a, c, t, g, unknown or other
  modified_base (477)..(477): a, c, t, g, unknown or other
  modified_base (498)..(498): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggagcttggtccagcctgggacggtccctaagctctcctgtgcagcctctgactcaccttcacgctcaatggccacgtacgtggactgggtcccnccgaggcctaccgaggggaagggctggggagtgggggttcggccgtttcaaggacgacacgaaactaacngtacgaccacgcaacaaatacccggccgtgtctaggtagaaacgggcaaggacttccacctatctacgaagagtatagacttcgaaagacgaacttctaacttttanctagaactaaaatcggaaacncgcctagaacgaacccgtacgacgtaccgggcttaactaatttcgttgcgttaacagttacgcttaggaatacgaagcggtgttaccgtggttaacgtcggg

SEQ ID NO: 426316 - DNA, 607 bp, Homo sapiens
  misc_feature: GZ8MTXP01B02Y2.3.17.B06.1.454.CMB.2.raw
  modified_base (348)..(348): a, c, t, g, unknown or other
  modified_base (366)..(366): a, c, t, g, unknown or other
  modified_base (475)..(475): a, c, t, g, unknown or other
  modified_base (496)..(496): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttatttacaaggtgtccagtgtgaggtgcaccgtggtggagtcgtgggggagcttggtccagcctggagggtccctaagactctcctgtgcagcctctggactcaccttcacgctcaatcggaccacgtacgtggactgggccgccaggctccgagggaagggctggagtgggttcgccgttnagagacaaccaactaacngtacgaccaaccgcaacaaagtaccgccgcgtctaggtagaaaggcaagacttcaaccatacctacgaaagagaatgaattacgaagaacgtaaccttctaacttttanacttagaacaaagtagaaacngtaccctagaaacgaaccgaacgaaccgacggtccgttacttaagtttacttgttgttacctaatagtaaccgtaaggtacttaaccgtaaacgggttaacgggtttaacg

SEQ ID NO: 426317 - DNA, 743 bp, Homo sapiens
  misc_feature: GZ8MTXP01AVTZ4.3.17.B06.1.454.CMB.2.raw
  modified_base (315)..(315): a, c, t, g, unknown or other
  modified_base (551)..(551): a, c, t, g, unknown or other
  modified_base (574)..(574): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacgtggtggagtcgtgggggaggcttggtccaggccgtgggacgggtccctaagacctctcctgtgcacgcctctggacctcaccttcacgctcaatcggcccacgtacggtggactcggggtcccnccgaggcctccggagggggaacgggggctgggggtaggttgggggtttcggcccggtttacgtaaggaacgaaccaaacgtaaactaacgaggtaccgaacccaccgacaaacgaacgtaacccggccgtcgtcgtaggtaacggaaacggcaacgtacttacccaaccctatcctaacgaaaggtagtaattacggtaacttacgaaagtaacgtaaaccttcttaacttttacncggtagaaactaaagtcgaaacncgtaccgtagaaaccggaaacccgcgtaaaccgaccgggtccctttaattaaagtttacgttcggttacgtaaactaacgttacggttaaaccgttaaggtaaaccgtaaacgtaaccggggtacggggtttccggttaaccggtttgggtttaacggtttcccggggg

SEQ ID NO: 426318 - DNA, 578 bp, Homo sapiens
  misc_feature: GZ8MTXP01ARCR8.3.17.B06.1.454.CMB.2.raw
  modified_base (305)..(305): a, c, t, g, unknown or other
  modified_base (340)..(340): a, c, t, g, unknown or other
  modified_base (354)..(354): a, c, t, g, unknown or other
  modified_base (445)..(445): a, c, t, g, unknown or other
  modified_base (465)..(465): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcaccgtggtggagtcgtgggggagcttggtccagcctggagggtccctaagctctcctgtgcagcctctggactcaccttcacgctcaatggccactacgtggactgggtccnccaggctccgagggagggctggagtgggtgcgttnagagacacaactangtcacaaccgcaacaatcgccgcgtctggtgaaagggcaagacttcaccatctacaaagtcgatgattcaagagaaactcgtaacttttanctagaactaaatacgaaacncgtacctaggaaacgaacccgaacgaaccgaccggtaccgttacttaagtttacgttgttcgttactaagtaacgaaccgtaaggacttaaccgtaacggttcgggttaacgg

SEQ ID NO: 426319 - DNA, 827 bp, Homo sapiens
  misc_feature: GZ8MTXP01CIDZ7.3.17.B06.1.454.CMB.2.raw
  modified_base (255)..(255): a, c, t, g, unknown or other
tcagagacgcactccacgaccggtgctcgatttagtcgatagtgaaggggagctctgagagcggagccccagccccagaattcccaggtgttttcatttggtgatcagcactgaacacagagactcacatggagtttgggctgagtcgttgggttttccttgttgttattttacaaggtgtccagtgtgaggtgcaccgtggtggagtcggtggggagtcttggtccagcgtggacggtcctaagctctcctgtncacgccctgtcgacctctaccttcacgctacatcggacctacgtacggtcggtaccgtcggggtccccgccgaagggtcccgtaccggggaaaggggggaacgggggtccgttagggggtacgggtttgggggttccgggtaccgtttacgaaaggaccgaacctaaaaccccgtaaaccgtaaacgtacgggtacgaaaccccgaaacccggtaacccaacgaaaccgttcccgggcccgggtccgtacgttaggtaacggaaaacgggcctaaggtacttaacccgacctaacttacgtaaaccgtaaacgaagtaactagtaaacgttaccgaaaggtaaccgttaaacgtttaccctttaaacgttttaaccgttaccgttaaactaaaccgtaaacgtaacgtaaaaccgtaccgtaacccgtaaccgggaaacccggtaaacccggaacccggtaaccggttacccggttaccgtttaacgtttaacgtttagttacgttacgttacgtaacgtaacgtaaccgtaacggtaaccgttaaccggtaacgggttaacgggttaacgg

SEQ ID NO: 426320 - DNA, 658 bp, Homo sapiens
  misc_feature: GZ8MTXP01AHOHN.3.17.B06.1.454.CMB.2.raw
  modified_base (309)..(309): a, c, t, g, unknown or other
  modified_base (507)..(507): a, c, t, g, unknown or other
  modified_base (528)..(528): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggaggcttggtccagcctgggacgggtccctaagctctcctgtgcagcctctggactcaccttcacgctcaatcggccactacggtggactcggggtcccncgaggcctaccggagggggaacgggcgtggggaggttgggggttcggccgtttagtaaggacgaccaactaaactaaacgaggtaccaaccaccgacaaaccaagtacccgcccgtcgtctaggtagaaaggcaagtacttccacctatccgtacaaagagtataggaattcgaaggactaaaccttctaacttttancgttagaactaaatcgaaacncgacctaggaaccgaaccgacgtaaccgaccgggtcttaactaagtttctcggttatacaagttaacggaccgttaagggaacctacgaacggtacgggttcggttacccgttgggttaacgttccgggg

SEQ ID NO: 426321 - DNA, 675 bp, Homo sapiens
  misc_feature: GZ8MTXP01ADY4I.3.17.B06.1.454.CMB.2.raw
  modified_base (301)..(301): a, c, t, g, unknown or other
  modified_base (334)..(334): a, c, t, g, unknown or other
  modified_base (349)..(349): a, c, t, g, unknown or other
  modified_base (360)..(360): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggagcttggtccagcctggacgggtccctaagctctcctgtgcagcctctggacctcaccttcacgctcaatggcccactacgtggactgggtccncaggctcgaggggaggctggagtgggtgcgttnagagacaacactacngtcgacaccgnacaataccgccgcgtctaggtagaaacgggtcaaggtactttcccgacctattaccgtacgaaaagtaggattggtaaactttacgaaaggtaacgtaaaccttcttaaacttttactaccggttaacgaaccttaaaatcgggaaaacctacggtcccctaagggaaaccgaaaccccgtacggaaaccccgtccgggggtacccttaattaacgtttagttcgttacgtaacctaagttaaccgttacccgttaaggaaccttaaccgaaccgggttcgggtacggttacccgttgggttaacgttcccgggg

SEQ ID NO: 426322 - DNA, 575 bp, Homo sapiens
  misc_feature: GZ8MTXP01AV74R.3.17.B06.1.454.CMB.2.raw
  modified_base (305)..(305): a, c, t, g, unknown or other
  modified_base (339)..(339): a, c, t, g, unknown or other
  modified_base (353)..(353): a, c, t, g, unknown or other
  modified_base (363)..(363): a, c, t, g, unknown or other
  modified_base (369)..(369): a, c, t, g, unknown or other
  modified_base (378)..(378): a, c, t, g, unknown or other
  modified_base (391)..(391): a, c, t, g, unknown or other
  modified_base (418)..(418): a, c, t, g, unknown or other
  modified_base (431)..(431): a, c, t, g, unknown or other
  modified_base (452)..(452): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggacgggtccctaagctctcctgtgcagcctctggactcaccttcacgctcaatggccactacgtggactgggccncaggctcgagggaggctggagtgggttgccgttnagagacacaactangtgacaccgnaacaancgccgcgtntgagaaacgcagntacacatcacaagagatgattcaaganaactctaactttnccgtagacctaaatgaaaccngtcccgtagaaaccgaaccgaacgacgttacccgggtcccttattaaagttacgtttgcggttacctaaagttacgaaccccgttaagggaacttaaccgggtaaacggttcggggttaacgg

SEQ ID NO: 426323 - DNA, 610 bp, Homo sapiens
  misc_feature: GZ8MTXP01CB31W.3.17.B06.1.454.CMB.2.raw
  modified_base (304)..(304): a, c, t, g, unknown or other
  modified_base (363)..(363): a, c, t, g, unknown or other
  modified_base (446)..(446): a, c, t, g, unknown or other
  modified_base (450)..(450): a, c, t, g, unknown or other
  modified_base (459)..(459): a, c, t, g, unknown or other
  modified_base (466)..(466): a, c, t, g, unknown or other
  modified_base (474)..(474): a, c, t, g, unknown or other
  modified_base (494)..(494): a, c, t, g, unknown or other
  modified_base (532)..(532): a, c, t, g, unknown or other
  modified_base (544)..(544): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggccacgtacgtggactgggtcccnccgaggcctccgagggggaacggggctggggaggttggggttcggccgtttcgtaaggngaaccacaaactaacgaggtcgaaccaccgacaacaaactccggcccgtcgtctgggtagaaagggcaagtattccacatcanaagnatgatcganagaactntactttanctagactaaaagtcgaaacngaccgtaggaacgaaccgacgaccgtaccggtccgttntaagtttgtcgngtaccaagttacgcttaagggtaactaacggaacggtcgggttcggttactgggttcttccggggg

SEQ ID NO: 426324 - DNA, 649 bp, Homo sapiens
  misc_feature: GZ8MTXP01B3EHJ.3.17.B06.1.454.CMB.2.raw
  modified_base (331)..(331): a, c, t, g, unknown or other
  modified_base (376)..(376): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtggggggagcttggtccagcctgggacgggcccctaagacctctcctgtgcagcctctggactcaccttcacgctcaatggccactacgtggactgggtcccgcaggctccgaggggaagggctggngtggggttggccgtttgagagacacaaactacagtcgaccaccgnaaccaatacccgccgcgtctggtagaaaagggcaaggtattacccacctaatctacgaaagagatagaattcaaggtanaactctaactttatccgttagactaaaatcggaaacacgcccgtagaaacgaacccgtacgacgaacccgggtccgttaactaagtttacgttgttcgttacgaagttacgttaaccgttaaacggaacgtaaaccgtaaccgggtaacggggttaccgggttacccgttaaggggttaacgtttcccgggggg

SEQ ID NO: 426325 - DNA, 611 bp, Homo sapiens
  misc_feature: GZ8MTXP01EPSGH.3.17.B06.1.454.CMB.2.raw
  modified_base (259)..(259): a, c, t, g, unknown or other
  modified_base (266)..(266): a, c, t, g, unknown or other
  modified_base (280)..(280): a, c, t, g, unknown or other
  modified_base (335)..(335): a, c, t, g, unknown or other
  modified_base (346)..(346): a, c, t, g, unknown or other
  modified_base (355)..(355): a, c, t, g, unknown or other
  modified_base (379)..(379): a, c, t, g, unknown or other
  modified_base (498)..(498): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttggggttttcctcgttgcttcttttaagaggtgtccagtgtcaggtgcagcgtggtggagtcgtgggggaggcgtgtccagccgtgggagtccctgacgactctcctgtncagcctntggtattcaccttnagtagatatgctatgtatgggtctcagctcgaggcgaagggggctggaggtgggnggctagttacnggtacacgntagaaagtaggaaagtaaaaaatnttaacgctaacgtactcccgtaggaacggtacgtattaccgacctatacctacccgaagtaacgaacctaattaacccaaactaacctaccccgttattaactttacgaaactaaacanaaaccgcgtaccgtaagacgaacgtagaaacgaccaaggtaaccttatcgttaattcgtagttcgcggagtaagcttaacgaacggacgggacgtaacgttaacgtaaccggg

SEQ ID NO: 426326 - DNA, 765 bp, Homo sapiens
  misc_feature: GZ8MTXP01B7CZQ.3.17.B06.1.454.CMB.2.raw
  modified_base (262)..(262): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagtcttgggttttccttgttgtttattttacaaggtgtccagtgtgaggtgcaccgtggtggagtcgtgggggagtcttggccagccgtgggacgggtccctaagactctcctgtgcagcctntggactccaccttcacgctacaagtcggacccaacgtacggtggaccgttcggggtccccgccgagggccctaccggaaaggggggtaacggggccttagggggagggtttcggggggtttcggtccccggtttagtaaggaacgtaacccaaactaaaccgtaaacgaggtacccgaaaccccaccggactaaaccgaaacgtaacccggcccgtcgttacgtagggtaaggaaacgggtccaaggtacttcccgaaccctataccctaagaaagagtaattagaatttacgaaggtaaactaaccttcttaaacttttacaccggtaagaacccgtaaaagtccggaaaactccggaccccgtaaggaaacccggaacccggtaacccgacgtaacccgggtccttaactttaagtttacgtggttactacgaattacgttaccgttaaggaactaaccgtaacggtacgggttacgttaccggttggttaacgttcgggg

SEQ ID NO: 426327 - DNA, 591 bp, Homo sapiens
  misc_feature: GZ8MTXP01BY04G.3.17.B06.1.454.CMB.2.raw
  modified_base (264)..(264): a, c, t, g, unknown or other
  modified_base (311)..(311): a, c, t, g, unknown or other
  modified_base (355)..(355): a, c, t, g, unknown or other
  modified_base (473)..(473): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtggggggagcttggtccaggcctggacgggtccctaagctctctgtgcagcctnggactcaccttcacgctcaatcggccactacggtggactgggtcccnccgaggcctccgaggggaacggggctgggagtgggttgccgttntagagacacaactacagtgacaaccgcaacataccgccgcgtctgagaaacgcagacttcacatcacaagagatgattcgagagtaactctaactttatctagtaaccaatcgaaacncgtaccgtagaaccggaacccggaaccgaccgaccgggtacccgttcttaagtttacgttgttcgttacctaagttacgaaccgttaaggacttacgaacggttaacgggtttaacgg

SEQ ID NO: 426328 - DNA, 859 bp, Homo sapiens
  misc_feature: GZ8MTXP01DGKRE.3.17.B06.1.454.CMB.2.raw
  modified_base (312)..(312): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggaggtcccctaagactctcctgtgcagcctctggactcaccttcacgctcaatcggaccacgtacgtggactcgggcccnccgaggcctccgagggggaacggggctgggaggttggggttcggccgtttcgtaaggacgaccaacccaaaccgttaaacgaggtacgaaccaaaccccggacaacgaaactacccgggcccgtacggtcctagggtaagggaaaacgggtcctaaagggtactttacccaacccctaatttacccgaacgtaaaagggaagtaaagttcgggtaaaacttttacccggaaaagggtaaacgttaaaaccctttaccgtttaaaccgttttttaaactcccgttaaggaaacccttaaaaagttaccgggaaaaaacctaccggtaccccgttaaacggggaaaacccggaaaacccccggggtaaacccggaaaccccgggttaaaccccgggggttccccgtttaaaccttttaaacgtttttaaggttttcggggttacctttaaccgtaaaacgttaaaaccgggttaaccccgttaaaagggggtaacctttaaaaaccccgggtaaacccgggggttaaccgggggttttaaacccggggg

SEQ ID NO: 426329 - DNA, 635 bp, Homo sapiens
  misc_feature: GZ8MTXP01AUTKY.3.17.B06.1.454.CMB.2.raw
  modified_base (251)..(251): a, c, t, g, unknown or other
  modified_base (292)..(292): a, c, t, g, unknown or other
  modified_base (305)..(305): a, c, t, g, unknown or other
  modified_base (358)..(358): a, c, t, g, unknown or other
  modified_base (364)..(364): a, c, t, g, unknown or other
  modified_base (371)..(371): a, c, t, g, unknown or other
  modified_base (375)..(375): a, c, t, g, unknown or other
  modified_base (380)..(380): a, c, t, g, unknown or other
  modified_base (388)..(388): a, c, t, g, unknown or other
  modified_base (425)..(425): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcttggtccagccgtggacgggtccctaagctctcctgtncagcctctggactcaccttcacgctcaatcggccatacggnggactgggtcccncaggcctacggagggggacgggctagggagtggggtcgcgttacaagcgacanaactanagcgacnccgnactancgctcgtngagaacgcagtactaccacctattacagaaggtaaanatagtactacgagaacgtaactacttacttactacgtacgtaactaaacgtaacgaacgacgaccgtaacggaaaccgaaccggtaaccggaccgtaccggtaccgttaacgttacgtttagttacgttacgttacgtaacgttaacgttacgttaacgtaacgtaccgtaaccggtacggttacggttacggttcggttaacggtcggg

SEQ ID NO: 426330 - DNA, 882 bp, Homo sapiens
  misc_feature: GZ8MTXP01DX1YP.3.17.B06.1.454.CMB.2.raw
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggaggcttggtccagcctgggacgggtcctaagactctcctgtgcagcctctggactcaccttcacgctcaagtcggaccactacggtggaccgtggggtccccgccgaggcctacccggaaggggggaaacgggggtccgtaggggacgggtttgggggttcgggtcccgtttacgtaaggacgaaccaaacccgtaaacgttaaaacgaggttacgaaacccgaaaccccggacaacccgtaaagtaccccggggtaccccgtacggtttaccgtagggttaaacgggaaaaacggggtccaaacggtaacttttacccaacccgtaattaccgttaaccgaaaaggtacgtaagttacggtaaatttaccgaaagggtaaaccttaaaaccgtttacccgtttaaaacttttttaacctacccgtttaaggaaacccttaaaaaaggtttacggaaaaaacccgttacggaacccccggttaaacgggaaaacccgggaaaaccccggaaaccccggtaaaccccgggttaaacccgggggtcccccgtttttaaattaaaccgttttacgtttaagggtttcttaaaccgtaacggttaaaccgtaaacccgttaagggtaaaccgttaccggtaaaaacccgggttcggggttttaaaccggg

SEQ ID NO: 426331 - DNA, 683 bp, Homo sapiens
  misc_feature: GZ8MTXP01D4UFI.3.17.B06.1.454.CMB.2.raw
  modified_base (315)..(315): a, c, t, g, unknown or other
  modified_base (557)..(557): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagtcttgggttttccttgttgttattttacaaggtgtccagtgtgaggtgcaccgtggtggagtcgtgggggagcttggtccagccgtggacggtccctaagctctcctgtgcagcctgtgactcaccttcacgctacaatcggccctacgtacgtggactcgggtcccnccgaggcctccgaaggggaacggggctagggaggttgggttcggccgttgtaagacgaaccaaccaaactaaacaggtacaacccgaaacccgacaacgaaactacccggcccgtacgttccgtagggtacggaaaacggccaagtactttaccaacctaattcctaacgaaagtagtatagaacttacgaagtaagtaaaccttactaacgttttacacgtagaaactaaagtacgaaacncgtaccgtaagaaacccgaaacccggaacgaccgttaccggtcctttaagttaagtttattcgttacgttaacgtaataacggtaaccgtaaggaacgttaaccgtaaacgggttccggttaacgg

SEQ ID NO: 426332 - DNA, 596 bp, Homo sapiens
  misc_feature: GZ8MTXP01A1KCU.3.17.B06.1.454.CMB.2.raw
  modified_base (307)..(307): a, c, t, g, unknown or other
  modified_base (354)..(354): a, c, t, g, unknown or other
  modified_base (399)..(399): a, c, t, g, unknown or other
  modified_base (449)..(449): a, c, t, g, unknown or other
  modified_base (465)..(465): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggtttttccttgttgttattttacaaggtgtccagtgtgaggtgcacctggtggagtcgtgggggagcttggtccagccgtggacgggtccctaagactctcctgtgcagcctctggactccaccttcacgctcaatggccacgtacggtggactgggtcccnccgaggcctaccggaggggacggggctgggaggtggggtgccgtttnagagaccacaaactacgagtcgaccaccgcaacaagtaccgccgngtcaggtacgaaagcaagacttcactatctacaagagatcgtatacaganaacttcacttttaacncgtagtaacaaatacgaaaccagaccgaagaaaccgaaccgacgaccgtaccggtcttaattattagtgttcgtacaagttacgacgttaggaataaccggaacggtcggtacggttacgtggttcgtcgg

SEQ ID NO: 426333 - DNA, 686 bp, Homo sapiens
  misc_feature: GZ8MTXP01AM1NE.3.17.B06.1.454.CMB.2.raw
  modified_base (305)..(305): a, c, t, g, unknown or other
  modified_base (520)..(520): a, c, t, g, unknown or other
  modified_base (549)..(549): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagccgtggacggtccctaagctctcctgtgcagcctcgtggactcaccttcacgctcaatcggccactacggtggacgtcgggtccnccgaggcctccggagggggagggctggggaggttgggggttcggccgtttcgtaaggacgtacaaacaaaccttaaacgaggtacgaaccaccgacaacaacgtaacccgcccgtcgtcgtaggtaggaaacggcagtacttaccaaccctattacgacaaaggtactagtacgtaacttaccgaaagaacgttaaacccttcttaactttttanaccgttagaaacctaaaagttacgaaacncggaccctaaaggaaaccggaaccccgggaaacctaccggaccgggtcccttaagtaactttggttcgttgtacctaagttacgacttaggaactacgaaacggttcggtacggttacctgggttaacgttcggggg

SEQ ID NO: 426334 - DNA, 620 bp, Homo sapiens
  misc_feature: GZ8MTXP01A7XZD.3.17.B06.1.454.CMB.2.raw
  modified_base (312)..(312): a, c, t, g, unknown or other
  modified_base (389)..(389): a, c, t, g, unknown or other
  modified_base (403)..(403): a, c, t, g, unknown or other
  modified_base (482)..(482): a, c, t, g, unknown or other
  modified_base (507)..(507): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcaccgtggtggagtcgtggggggagcttggtccaggccgtgggacgggtccctaagacctctcctgtgcagcctctggactcaccttcacgctcaatcggcccacgtacgtggactcggggtcccnccgaggcctccgagggggaaggggctggggagttggggttcgccgtttctaggagacacaactacagtcgaccacgnaacaactaccgccncgtctggtagaaaggcaagacttaccacctatcctacaagagtataggattacgaagtaacgtaactctaacttttacncgttacggaactaaaagtgaaaacncgtacctaggaacgaaccgtacgacaccgggtccttaattattacgtgttcgactaattacggacttaaggaactaacgaacgtacgggtcgttaccgtggttaacgtccggg

SEQ ID NO: 426335 - DNA, 624 bp, Homo sapiens
  misc_feature: GZ8MTXP01A425W.3.17.B06.1.454.CMB.2.raw
  modified_base (307)..(307): a, c, t, g, unknown or other
  modified_base (358)..(358): a, c, t, g, unknown or other
  modified_base (370)..(370): a, c, t, g, unknown or other
  modified_base (378)..(378): a, c, t, g, unknown or other
  modified_base (499)..(499): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccaggcctggagggtccctaagactctcctgtgcagcctctggactcacccttcacgctacaatggaccactacggtggactgggtcccnccaggcctccgagggggaaggggctaggggaggtcgggggttgcccgtttntaaggagaccanaaactacnggtacaccaccgcaacaacgtaccgcccgcgtctaggacgaaaaggcaagacttccaccctatctacaaagagatacgattcgaagtacaactctaactttactcagtacaaatcgaaacncgaccgtagaaccggaaccgaacggaaccgaccgggtctaacttaaattgttacgttcgtactagttaacgttacgttacggtaataacgaaccggtaggtcggttacgtggttaacgttccggg

SEQ ID NO: 426336 - DNA, 654 bp, Homo sapiens
  misc_feature: GZ8MTXP01EJ2B4.3.17.B06.1.454.CMB.2.raw
  modified_base (181)..(181): a, c, t, g, unknown or other
  modified_base (258)..(258): a, c, t, g, unknown or other
  modified_base (265)..(265): a, c, t, g, unknown or other
  modified_base (317)..(317): a, c, t, g, unknown or other
  modified_base (539)..(539): a, c, t, g, unknown or other
  modified_base (545)..(545): a, c, t, g, unknown or other
  modified_base (553)..(553): a, c, t, g, unknown or other
  modified_base (558)..(558): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagtcttgggttttccttgttgttattttacaaggtntccagtgtgaggtgcaccgtggtggagtcgtgggggagcttgggtccagccgtggacggtccctaagctctcctgtncagcctnggactcaccttcacgctcaatcggacctacgtacggtggacttcggggcccnccaggctaccggagggggaacggggtcttagggggagtttcgggggtttcggccccgtttgaaggacaaccgtaaccctaaactaacgaggtacgaccgaaaccccgctaacgaaacttcccggcccggtacgttctagggaagaaagggcaagtacttcccaacctattcctaacgaaaagtcgataggacttacgaaggtaactaacttctaattttacncgtaanaactaaangaacngacctagaaccgaccgaacgtacgaccggtcttataagtttacgttcgttcttaactaagtaccgaacgtaagacttacggtaacgggttggttcg

SEQ ID NO: 426337 - DNA, 736 bp, Homo sapiens
  misc_feature: GZ8MTXP01B1KKD.3.17.B06.1.454.CMB.2.raw
  modified_base (260)..(260): a, c, t, g, unknown or other
  modified_base (283)..(283): a, c, t, g, unknown or other
tcagagacgcactccacgaccggtgctcgatttagtcgatagtgaagggggagagcagagccccagccccagaattcccaggtgttttcatttggtgatcagcactgaacacagaggactcaccatggagtttgggctgagcttgggttttccttgttgttattttacaaggtgtccagtgtgaggtgcaccgtggtggagtcgtgggggagcgttggtccagcctggacgggtcccctaagcctctcctgtgcagcctntggacctcaccttcacgctcaancggaccacgtacggtggacgtcgggtcccgcgaggcctccggaggggaagggggctgggaggtgggttggccgtttagagagacacaactaacaggtcgaacacccgacaacaaactaccgccgcgtctaggtagaaacgggctaacgtactttacccaacccgtaatttccccgaagaaaggtagtaagttaggtaactttacgaaagttaacgtaaaccttcgttaaacttttactacgtagtaaacctaaaagttacggaaaccctaggtacccgtaaggaaaccggtaaccccggtaacggaaccccggttaccggggtccctttaaacgtttaacgtttacgtttaggttcggtaaccttaacggttaccgttaacccgttaagggtaaacttaaccggtaaaccgggtcggggtttacgttaacccgggtttggggtttaacccggg

SEQ ID NO: 426338 - DNA, 622 bp, Homo sapiens
  misc_feature: GZ8MTXP01BEBE7.3.17.B06.1.454.CMB.2.raw
  modified_base (257)..(257): a, c, t, g, unknown or other
  modified_base (270)..(270): a, c, t, g, unknown or other
  modified_base (307)..(307): a, c, t, g, unknown or other
  modified_base (346)..(346): a, c, t, g, unknown or other
  modified_base (354)..(354): a, c, t, g, unknown or other
  modified_base (360)..(360): a, c, t, g, unknown or other
  modified_base (369)..(369): a, c, t, g, unknown or other
  modified_base (386)..(386): a, c, t, g, unknown or other
  modified_base (463)..(463): a, c, t, g, unknown or other
  modified_base (474)..(474): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacgtggtggagtcgtggggggagcttggtccaggcctggacgggtccctaagctctcctgtgcagcctntggactcaccttnacgctcaatcggccacgtacgtggactcggggtcccncaggcctcgagggggagggctggaggtgggttgccgttnagagacanaactangtcacacgnaacagtacgccgcgtcngtaggaaagcaagacttacacccataccgtacaaagtgataggaaacttcgaagaacgtaaacttctaacttttaancgtagaataanacgaaacgtcgaccgtaaggaaccgaaacccggtcgaacccgtaccggtcccgtttaattagtttacgttaggcgtaacgtaagttaaccgacgttaaggaacctacggtaacgggtacgggttacgttacgttgggttaacgtcggg

SEQ ID NO: 426339 - DNA, 746 bp, Homo sapiens
  misc_feature: GZ8MTXP01AE5V5.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggaggcttggtccaggcctgggacgggtccctaagctctcctgtgcagcctcgtggactcaccttcacgctcaatcggccacgtacggtggaccgtgggtcccgccgagggccctccggaagggggacggggcgttaggggaggttgggggttcggccgtttacgtaaggacgtacaacaaactaacgagtccgaccacgacaacgaactacccgcccgtcgtctaggtagaaacggccaaggtacttaccaaccctatcctaagaaacggagtatacggtattaccgaaaggtacgttaaaccttctaacttttttagcggttaacgtaaacctaaaagttacggaaaccgtacgtacccggtaaggaaaaccggaaaccccggtcggaaacccgtacccgggggtccctttaatttaaacgttttacgttaggggttacgtaacccgtaagttaacccggttaaccgttagggtaaccttaaacgaaaccgggggtcggtttacgggttaccgttaagggtttaacgttccgggggg

SEQ ID NO: 426340 - DNA, 823 bp, Homo sapiens
  misc_feature: GZ8MTXP01AYBTT.3.17.B06.1.454.CMB.2.raw
  modified_base (323)..(323): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacgtggtggagtcgtgggggagtcttggtccagccgtggacggtccctaagctctcctgtgcagcctcgtgacctcaccttcacgctacaatcggaccctacgtacggtggtaccgtcggggtccccncccgaggcctacccggagggggaaacgggggtccgtagggggtagggtttgggggtttacggtcccggtttacgtaaggaacgtaaccaaaccctaaaccgttaaacgaggtacgaacccaaacccggaccaacgtaacgtaacccgggcccggtacgttacgtagggtaagaaaacgggcctaaaggtacctttaccgaaacccattacccgaacgaaaggtagtaatttaggaactttaccgaaagggtaaaccgttaaacccgtttccttaaacttttttaacggacccttaaggaaaccttaaaaacgttacggaaaaccctacggtaccccgtaaagggaaaccggaaaacccccggaaccggtaaacccgacccgggggttaccctttaacggttaaacgtttaaggtttcgttcggttaaccttaacggtaacggtaaaccgttaacgggtaccttaaaaccggtaacccgggggtttaacgttaaccggggg

SEQ ID NO: 426341 - DNA, 836 bp, Homo sapiens
  misc_feature: GZ8MTXP01DWMEO.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttggctgagcttgggttttccttgttgttatttacaaggtgtccagtgtgaggtgcacgtggtggagtcgtgggggagtcgttggtccagccgtgggacggtaccctaagcctctcctgtgcagcctcgtgactccaccttcaccgctacaatcggacctacgtacggtcggaccgttcggggtccccgaccgaaggcccgtaccgggaaaggggggtaacggggtcggtagggggtaagggttcgggggtttacgggtaccccggttttacgtaaaggaaccggtaaacctaaaaccgtaaaaccgttaaacgtaacgggtaccgaaaccccgaaccggacaaaccgtaaacgtaaccccgggccgtcggttacgtaggtaaacgggaaaacgccgtaagtactttacccaacctattaccaagaaagtgtaaattaggtactttaaccgaaggtaaactaaaccttcttaaactttttaacacgtaaagtaaactaaaagtacgaaaccgacgtaaccggtaacggaaaaccggaacccgtaaccggtaacccggtacccggttaacctttaagttttaaagtttacgttacggttaacgttaaaccgtaagttaacccggttaacgttaaaggtaaacctaaaacgggtaaccgggttacggggtttacggttaccgggttcgggtttaaccggttccgggg

SEQ ID NO: 426342 - DNA, 818 bp, Homo sapiens
  misc_feature: GZ8MTXP01EXCRL.3.17.B06.1.454.CMB.2.raw
  modified_base (269)..(269): a, c, t, g, unknown or other
  modified_base (281)..(281): a, c, t, g, unknown or other
  modified_base (286)..(286): a, c, t, g, unknown or other
  modified_base (291)..(291): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcaccgtggtggagtcgtgggggagcttggtccagcctgggaggtccctaagactctcctgtgcagcctctggactcacctcncgctcaatgccnctcgngtacncgtccgccgtcgtccgtacgtactaggggggcggtcgggtacggttacgggttacggaccggttacgtaacgaacgtaacaaccgtaaacgtaacgcgtacgaccacgaccgtaacgtaaccgtaccggtaccgtcggtacgtaacggtacggtaaacggaccgtaccgtaacttacccaacccgtaaacgtacgtaacgaaagtaacggtaatttacggtaaacttaccgtaaaccggttaactaacccgtttaaccgttaaccttaaacgttaccggtaacggaaacgtaaaaccgttaccgggaaaccgtaacccggtaccggtaaaccggaaacccggtaaacccgtaacccggtaaacccgttaccggttaccgtttaacgtttaaacgtttacggttacggttaacgtaaacccgtaaacgttaaaccggttaccgttaaacgggttaaccgaacggtttaacccggtacgggttaccggttaccgggttttaaccgggttaacgggtttaaccccggggg

SEQ ID NO: 426343 - DNA, 721 bp, Homo sapiens
  misc_feature: GZ8MTXP01AO8Y7.3.17.B06.1.454.CMB.2.raw
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagccgtgggagggtccctaagactctcctgtgcagcctctggacctcacccttcacgctacaatcggccacgtacgtggactcgggtcccaccgaggctccgaggggaagggctgggaggttgggttggccgtttgtagagacaacaactaacgaggtccgaccaccgacaacaactaaccgcccgtcgtcgtaggtaggaaacgggtcaagtacttcccaacctattaccgacgaaagaggaattcggtaacttacgaagtaacgtaaaccttctaactttttacgccttaaggaacctaaaagtcgaaaccgacgcccgttaaggaaaccgaaaccccgtaccgaaccgtaaccggggtccccgtttaactttaaagttttagttcggttacgttaaacccgtaattaaacccgggttacccgttaaggggtaaactaacccgggaaacgggttacccgggttagggtttaccccgtttggggttaaccggtttccggggg

SEQ ID NO: 426344 - DNA, 624 bp, Homo sapiens
  misc_feature: GZ8MTXP01EWXOG.3.17.B06.1.454.CMB.2.raw
  modified_base (252)..(252): a, c, t, g, unknown or other
  modified_base (308)..(308): a, c, t, g, unknown or other
  modified_base (386)..(386): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgtttattttacaaggtgtccagtgtgaggtgcacctggtggagtcgtgggggaggcttggtccagcctgggagggtccctaagactctcctgtncagcctctggactcaccttcacgctacaatcggccacgtacgtggactgggtcccnccgaggcctaccgagggggagggctggggagttgggggttcgccgttactagagacacaataacagtaccgacaccgnaacaaacgtaaccgccgcgttcaggtagaaaacggcagtacttaccacctatctacgaaagatagtagatttacaaggtaagaacttctaacttttacacgttagaaactaaatacgaaacacgcctaggaacgaacccgagaccgacggtcctaattatttagttcgttagtactaagttacgacgttaggaataaccgtaaacggtcggggtacgttaccgtggtttaacgtcggg

SEQ ID NO: 426345 - DNA, 647 bp, Homo sapiens
  misc_feature: GZ8MTXP01ATHST.3.17.B06.1.454.CMB.2.raw
  modified_base (194)..(194): a, c, t, g, unknown or other
  modified_base (257)..(257): a, c, t, g, unknown or other
  modified_base (298)..(298): a, c, t, g, unknown or other
  modified_base (309)..(309): a, c, t, g, unknown or other
  modified_base (352)..(352): a, c, t, g, unknown or other
  modified_base (367)..(367): a, c, t, g, unknown or other
  modified_base (379)..(379): a, c, t, g, unknown or other
  modified_base (424)..(424): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtncaccgtggtggagtcgtgggggagcttggtccagcctgggacggtccctaagctcctcctgtncagcctcgtgactccaccttcacgctcaatcggccatacgnggactgggccncgaggcctcgaggggaacgggctggagtgggttcggcccgttntagagacacaactangtacgacaccgnaacagtccgcgcgtctgagaaagcagtataccactaatccgtaanaaaggatataggtaacttacgaaggtaaacaacgttctaaactttaaacggcgttaacgaaaccgttaaatcggaaaacctaacgtcccgttaaggaaaccgaaacccggaacgtaaacgaaccccggggtccctttacggtaaattttccgttagtttacgttcctaaagttaccgaacgttaaacgggtacttaaccggtaaccggttaacgggtttcggg

SEQ ID NO: 426346 - DNA, 631 bp, Homo sapiens
  misc_feature: GZ8MTXP01CAF6I.3.17.B06.1.454.CMB.2.raw
  modified_base (270)..(270): a, c, t, g, unknown or other
  modified_base (310)..(310): a, c, t, g, unknown or other
  modified_base (355)..(355): a, c, t, g, unknown or other
  modified_base (398)..(398): a, c, t, g, unknown or other
  modified_base (487)..(487): a, c, t, g, unknown or other
  modified_base (548)..(548): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggacgggtccctaagctctcctgtgcagcctctggactcacccttnaccgctacaagtcggcccacgtacgtggactggggtcccnccgaggctccgaggggacgggctgggagtgggttgccgttcaggngacacaactaacagtcgaccaccgcaacaactaccgccgcgtntgagaaaggcagacttccacatacacaaggacagttacgatttacgaaggataaacctctaaactttatcgtagaaccaaatcgaaacncgtaccgtagaaccggaacccgcggaaaccgtaccgggcccttaattaacgttattttcgngttacaacggttacgttaaccgttaagggaatccggtaaacgggacggttcgggttacccgttaagggttaacgttcccgggg

SEQ ID NO: 426347 - DNA, 528 bp, Homo sapiens
  misc_feature: GZ8MTXP02I2Z24.3.17.B06.1.454.CMB.2.raw
  modified_base (304)..(304): a, c, t, g, unknown or other
  modified_base (339)..(339): a, c, t, g, unknown or other
  modified_base (435)..(435): a, c, t, g, unknown or other
tcagagacgcactccacgaccggtgctcgatttagtcgatagtgaaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagactctcctgtgcagcctctggactcaccttcacgctcaatggccactacgtggactgggtccnccaggctccagggagggctggagtgggtgccgttntagagacacaactaacagtgacaccgcacaatacgccgcgtctgtgaaaggcagattcaccatctcaagagatgattcaagagaactcaactttanctagacaaaatgaacagcctagaacgaacccgacgacacggccgtactaattacttgtgtcaagtagacctaggatacgaacgacggttacgg

SEQ ID NO: 426348 - DNA, 539 bp, Homo sapiens
  misc_feature: GZ8MTXP02JDEN0.3.17.B06.1.454.CMB.2.raw
  modified_base (304)..(304): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggtttccttgttgttatttacaaggtgtccagtgtgaggtgcacctggtggagtctgggggaggcttggtccagcctggagggtccctaagactctcctgtgcagcctctggactcaccttcacgctcaatggccactacgtggactgggtccnccaggcctccgagggaaggggctggagtggggttggccgttctagagacaccaactaacagtgacaccgcacaaatacgccgcgtctgtgaaaggcagattcaccatctcaagagatgattcagagaaactcactttatctagacaaatgaaacagcctagaacgaacccgacgacacggccgtactaacttactacgtgtcaagtacgaccgtaggatacgaacgacggtacgg

SEQ ID NO: 426349 - DNA, 541 bp, Homo sapiens
  misc_feature: GZ8MTXP02FOUXV.3.17.B06.1.454.CMB.2.raw
  modified_base (306)..(306): a, c, t, g, unknown or other
  modified_base (345)..(345): a, c, t, g, unknown or other
  modified_base (390)..(390): a, c, t, g, unknown or other
  modified_base (440)..(440): a, c, t, g, unknown or other
  modified_base (455)..(455): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggtccnccaggctccgaggggagggctgggagtggggtgccgttntagagaccacaactaacagtgacaccgcaacaataccgccgcgtngtgaaagcagattcacatcacaagagatgattcgagagaactcactttanctgacaaatgaaacngacctagaacgaaccgacgacgaccggtccttactattacgttgtagtaactaagtaacgaccgtaggaactaacgaacggtacgg

SEQ ID NO: 426350 - DNA, 545 bp, Homo sapiens
  misc_feature: GZ8MTXP02F2W6L.3.17.B06.1.454.CMB.2.raw
  modified_base (260)..(260): a, c, t, g, unknown or other
  modified_base (306)..(306): a, c, t, g, unknown or other
  modified_base (326)..(326): a, c, t, g, unknown or other
  modified_base (348)..(348): a, c, t, g, unknown or other
  modified_base (445)..(445): a, c, t, g, unknown or other
tcagagacgcactccacgaccggtgctcgatttagtcgatagtgaagggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttgggtccagcctggagggtccctaagctctcctgtgcagcctntggactcaccttcacgctcaatggccactacgtggactggggtccnccaggctccgaggggaaggngctgggagtggggttgccgttnagagaccacaactaacagtgacaccgcacaatacgccgcgtctgtagaaagcagattcaccatcacaagagatagattacagagaactctactttanctagacaaatgaaacagacctagaacgaaccggacgacgacggcccgtattacgttacttgtagtccaagtacgaacctaggactaacgaacggtacggg

SEQ ID NO: 426351 - DNA, 554 bp, Homo sapiens
  misc_feature: GZ8MTXP02G71IL.3.17.B06.1.454.CMB.2.raw
  modified_base (300)..(300): a, c, t, g, unknown or other
  modified_base (408)..(408): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccnccaggctccaggggagggctggagtgggtgccgtttctagagacacaaactaacagtcgaccaccgcaacaataccgccgcgtctgtgaaaagcaagattcaccatcncaagagatgattcagagaactcaactttatctgacaaaatgaaacagcctagaacgaaccgacgaacgacggccgtactagttattcgtgtacagttacgaccttaaggaataacgaacgtacggtgtaacctgggtaacttcggg

SEQ ID NO: 426352 - DNA, 542 bp, Homo sapiens
  misc_feature: GZ8MTXP02IOSW7.3.17.B06.1.454.CMB.2.raw
  modified_base (300)..(300): a, c, t, g, unknown or other
  modified_base (431)..(431): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggccactacgtggactgggtccnccaggctccgaggggaagggctgggagtggggttgccgttctagagacacaactaaacagtcgacaccgcacaataccgccgcgtctgtgaaagcagattcaccatctcaagagatgattcagaagaactnaactttatctgtacaaaatgaaaccagcctgagaaacccgacgtacacggccgtactatttattgtagtcataacgcctaggaatacaacgacggtgtacctggtattcgg

SEQ ID NO: 426353 - DNA, 701 bp, Homo sapiens
  misc_feature: GZ8MTXP02JQIND.3.17.B06.1.454.CMB.2.raw
  modified_base (470)..(470): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagggcgttggtccgacgccgtcgggtagggtacccgtaacgacgtcctcctgtgcacgcctctggactcaccttcacgctcaatcgccactacgtcggacgtcgggtccggccgacggccgtccgaggggaaggggcgtgggagggtggggttcgggccgttcgtaggagacaacccgaactaaacagtacgaccaccgacacaaacgtacgcccgacgtctggtagaaaggcagtacttcaccattcacaaaggntaatgacttacaaaggactaaacttcctaacttttatacccgtagaaactaaaacgtagaaaaccgacggcccttaaagggaacggaaaaacccccggtacgaaaacccggcccggggttacccctttacttaagtttaaacgtttggtacggttaccaaagttaacggggtaaaaccccttagggggaaactttaaaacccggaaacccgggttacggggtttaacccgg

SEQ ID NO: 426354 - DNA, 568 bp, Homo sapiens
  misc_feature: GZ8MTXP02GBEUG.3.17.B06.1.454.CMB.2.raw
  modified_base (302)..(302): a, c, t, g, unknown or other
  modified_base (341)..(341): a, c, t, g, unknown or other
  modified_base (432)..(432): a, c, t, g, unknown or other
  modified_base (437)..(437): a, c, t, g, unknown or other
  modified_base (446)..(446): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctggagggtccctaagactctcctgtgcagcctctggactcaccttcacgctcaatggccactacgtggactgggtccnccaggctccgaggggagggctgggagtgggtggccgttnagagacacaaactaacagtcgaccaccgcaacaataccgccgcgtctgtagaaagcaagattccaccatctacaaagagatgattcaaganaactntaactttanctagacaaaatcgaaacacgcctaggaacgaaaccgacgacgacgggcccttactaatttagttgtacgtacaatacgaccttaaggaataacgaagtcggaggtacgtacgtagtttacgg

SEQ ID NO: 426355 - DNA, 604 bp, Homo sapiens
  misc_feature: GZ8MTXP02FSC5T.3.17.B06.1.454.CMB.2.raw
  modified_base (264)..(264): a, c, t, g, unknown or other
  modified_base (309)..(309): a, c, t, g, unknown or other
  modified_base (341)..(341): a, c, t, g, unknown or other
  modified_base (451)..(451): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggaggcttggtccagccgtggagggtccctaagctctcctgtgcagcctcnggactcaccttcacgctcaatggcccactacgtggactgggtccnccaggctcgagggagggctggagtggtggctnagagacacaactacagtgaccaccgcacaatccggaccgcgtctgtagaaaggcagattcaaccatcgtacaagagatgaattcaagaacgtaactctaactttttaacncgtagaactaaagtacgaaaccgtaacgtccgaaggaaaccggaaaccccgaacgaccgtaaccgggtcccgttattaaacgtttagttacgtacgtactaaagtaacggtaaccgttaaaggaactaaaccggaaaccggtacggggtaacg

SEQ ID NO: 426356 - DNA, 535 bp, Homo sapiens
  misc_feature: GZ8MTXP02IQRI9.3.17.B06.1.454.CMB.2.raw
  modified_base (394)..(394): a, c, t, g, unknown or other
  modified_base (434)..(434): a, c, t, g, unknown or other
  modified_base (447)..(447): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttatttacaaggtgtccagtgtgaggtgcacctggtggagtctgggggaggcttggtccagcctggagggtccctaagactctcctgtgcagcctctggactcaccttcacgctcaatggccactacgtggactgggtccgccaggctccgaggggaaggggctgggagtgggttggccgttcagagaccacaactacagtgaccaccgcaacaaataccgccgacgtcngtagaaaggcagatcaccatctcaagagatgattcagtanaactcaactttantagacaaatcgaacagctagaacgaaccgacgacgaccgtctactacttacgtgtagtaacgaatacgactagactacgaacgtacgg

SEQ ID NO: 426357 - DNA, 541 bp, Homo sapiens
  misc_feature: GZ8MTXP02G93II.3.17.B06.1.454.CMB.2.raw
  modified_base (302)..(302): a, c, t, g, unknown or other
  modified_base (341)..(341): a, c, t, g, unknown or other
  modified_base (358)..(358): a, c, t, g, unknown or other
  modified_base (428)..(428): a, c, t, g, unknown or other
  modified_base (441)..(441): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctcaatggccactacgtggactgggtccncaggctccaggggaagggctggagtgggttggccgtttnaggagacacaactaacngtcgacaccgcaacaataccgccgcgtctgtgaaaaggcaagattcaccatctcaagagatgattcaganaactcaactttanctgacaaaatgaaacagcctagaacgaaaccgacgacacgggcctactattattgtgtacatacgacctaggaatacaacgacggtgtacctggtatcgg

SEQ ID NO: 426358 - DNA, 560 bp, Homo sapiens
  misc_feature: GZ8MTXP02IO8FT.3.17.B06.1.454.CMB.2.raw
  modified_base (302)..(302): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggtttccttgttgttatttacaaggtgtccagtgtgaggtgcacctggtggagtctgggggagcttggtccagcctggagggtccctaagactctcctgtgcagcctctggactcaccttcacgctcaatggccactacgtgactgggtccncaggctccagggagggctggagtgggttgccgttcagagacacaactaacagtgacaccgcacaatacgccgcgtctgtgaaaggcagattcacatctacaagagatgattcaagagaaactctaactttatctagacaaataagaacacgacgtacgacgaaacgaaccgaaccgaccggaccgtacttaacttacgttacgttagtactaagtaacgtaacgtaacggtaacgtaacgtaaacggtaacggtacgg

SEQ ID NO: 426359 - DNA, 559 bp, Homo sapiens
  misc_feature: GZ8MTXP02JS8OI.3.17.B06.1.454.CMB.2.raw
  modified_base (298)..(298): a, c, t, g, unknown or other
  modified_base (338)..(338): a, c, t, g, unknown or other
  modified_base (366)..(366): a, c, t, g, unknown or other
  modified_base (441)..(441): a, c, t, g, unknown or other
  modified_base (503)..(503): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtctggggaggcttggtccagcctggagggtccctaagactctcctgtgcagcctctggactcaccttcacgctcaatggccactacgtggactgggtcccnccaggctccgaggggagggctggagtgggttggccgtttnaggagacacaactaacagtcgacaccgnaaccaataccgccgcgtctggtagaaaaggcagattcaccatctacaagagatgattcagagaaactctatttanctagacaaatgaaacagcctagaacgaaccgacgaacaccgggccttactagttattcggtntactatacgtactaagaactaacgaaacggtacggtacggtaccgtggtacgtcgg

SEQ ID NO: 426360 - DNA, 643 bp, Homo sapiens
  misc_feature: GZ8MTXP02GE07Q.3.17.B06.1.454.CMB.2.raw
  modified_base (305)..(305): a, c, t, g, unknown or other
  modified_base (439)..(439): a, c, t, g, unknown or other
  modified_base (476)..(476): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggaggtccctaagactctcctgtgcagcctctggactcaccttcacgctacaatcggccactacggtggactggggtcccnccaggcctccgaggggaacggggctgggaggttggggttcggccgtttcgtaggacgacaacgaaactaacgagtaccgaccaccgacaacaagtaccgccgcgtctggtagaaaggcagacttcactatccanaagagatgattcgaagtagaaacctctaacttttacnctacgaactaaagtacgaaacgacgtaccgtaaggaaaccgaaaccgacgaaccgaccgggtccttaacttaagtttgttacggtacgttactaacgtaaacgaaccgtaaggaaacgtaaccgaaacgggtacgggttacggtaaccgttgggttacgtttccggg

SEQ ID NO: 426361 - DNA, 585 bp, Homo sapiens
  misc_feature: GZ8MTXP02HAZT8.3.17.B06.1.454.CMB.2.raw
  modified_base (456)..(456): a, c, t, g, unknown or other
  modified_base (460)..(460): a, c, t, g, unknown or other
  modified_base (487)..(487): a, c, t, g, unknown or other
  modified_base (504)..(504): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatcggccactacggtggacgtcgggtccgccgaggcctaccggagggggaacggggcgtggggagggttggggttcggcccggtttacgtaggacgacaaccaaactaacgagtacgaccaccgacaccaaactaccggcccgcgtctgtagaaacggcagtacttcacatcanaagngatgattcaagacgaactctactttanctagactaaatgaaacngcctagaacgaacccgacgacgacggcctatattacgtgtctacaagttaacgacctaggactacgaacggtcggttaacg

SEQ ID NO: 426362 - DNA, 545 bp, Homo sapiens
  misc_feature: GZ8MTXP02IYVEF.3.17.B06.1.454.CMB.2.raw
  modified_base (301)..(301): a, c, t, g, unknown or other
  modified_base (409)..(409): a, c, t, g, unknown or other
  modified_base (415)..(415): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactgggtccnccaggctccgaggggagggctgggagtggggttgccgtttctagagacacaactaacagtcgacaccgcacaataccgccgcgtctggtgaaagcagattcaccatcncaaagngatgattcagagaactctactttatctgacaaatgaaacagcctagacgaaaccgcgacgacggccgtactatttatcgtagtcatacgacctaggaactacgaacggacggtgtacctggtacttcggg

SEQ ID NO: 426363 - DNA, 539 bp, Homo sapiens
  misc_feature: GZ8MTXP02JWIUF.3.17.B06.1.454.CMB.2.raw
  modified_base (368)..(368): a, c, t, g, unknown or other
  modified_base (425)..(425): a, c, t, g, unknown or other
  modified_base (437)..(437): a, c, t, g, unknown or other
  modified_base (451)..(451): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctggggaggcttggtccagcctggagggtccctaagactctcctgtgcagcctctggactcaccttcacgctcaatggccactacgtggactgggtccgccaggctccaggggaagggctggagtggggttggccgtttctagagacacaactaacagtcgacaccgnaacaatacgccgcgtctgtgaaaggcagattcaccatctcaaagagatgattcaganaactcactttanctgcaaatgaaacngccctagacgaaacccgacgaaccacgggccgtctattatcgtagtcatacgacctaggaatacaacgacggtgtacctggtattcgg

SEQ ID NO: 426364 - DNA, 548 bp, Homo sapiens
  misc_feature: GZ8MTXP02HNG6C.3.17.B06.1.454.CMB.2.raw
  modified_base (302)..(302): a, c, t, g, unknown or other
  modified_base (346)..(346): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctggagggtccctaagactctcctgtgcagcctctggactcaccttcacgctcaatggccactacgtggactggggtccnccaggcctccgaggggaaggggctgggagtggggttggccgttntaggagacacaaactaacagtcgaccaccgcacaataccgccgcgtctggtagaaaggcaagatttcacccatctacaagagatgattcagagaactcactttatctgacaaatcgaaacagcctagaacgaaccgacgacacggccgtactattactgtgtacatacgacctagaatacacgacggtgacctggtatcggg

SEQ ID NO: 426365 - DNA, 628 bp, Homo sapiens
  misc_feature: GZ8MTXP02IKPA8.3.17.B06.1.454.CMB.2.raw
  modified_base (466)..(466): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcttgggttttccttgttgttattttacaaggtgtccagtgtgaggtgcacctggtggagtcgtgggggagcttggtccagcctgggacggtccctaagactctcctgtgcagcctctggactcaccttcacgctcaatcggcccactacgtggaccgtggggtcccgccgaggcctccggaaggggaacggggctggggaggttggggtttcggccgttcgtaggacggacaacccaaacctaaacgagtacgaaccacccgcaccaaagtaccgcccgcgttcctaggtagaaacggcaagacttccaaccatcctanaaagagatgattacgagtaacgaaacttcgtaatttatctagaactaaaatacgaaactacgaccctagaaacgaaacccgacgaaaccgaccggcccgttataatttacgttgtacgtacaaagtacgaacttaggaactaaccgaacggttacggtacgg

SEQ ID NO: 426366 - DNA, 545 bp, Homo sapiens
  misc_feature: GZ8MTXP02G3CN6.3.17.B06.1.454.CMB.2.raw
  modified_base (301)..(301): a, c, t, g, unknown or other
  modified_base (343)..(343): a, c, t, g, unknown or other
  modified_base (369)..(369): a, c, t, g, unknown or other
  modified_base (380)..(380): a, c, t, g, unknown or other
  modified_base (387)..(387): a, c, t, g, unknown or other
  modified_base (426)..(426): a, c, t, g, unknown or other
  modified_base (439)..(439): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggaggcttggtccagcctgggagggtccctaagactctcctgtgcagcctctggactcaccttcacgctcaatggccactacgtggactgggtccnccaggctccaggggaaggggctgggagtggggttggccgttntagagacacaactacagtgacaccgnacaataccgcncgtctgngaaagcaagattcaccatctacaagagatgattcaaganaactcaactttanctgacaaatgaaaccagacctagaagaacccgacgaacgacggccctactagttaatgtagtcatacgaactaggaatacgaaacgtcggtagacctggtactcgg

SEQ ID NO: 426367 - DNA, 589 bp, Homo sapiens
  misc_feature: GZ8MTXP02HPQW3.3.17.B06.1.454.CMB.2.raw
  modified_base (300)..(300): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggaggcttggtccagcctggagggtccctaagactctcctgtgcagcctctggactcaccttcacgctcaatggccactacgtggactgggtccnccaggctccgaggggagggctggaggtgggttggccgtttctagagacacaactaacagtcgacaccgcaacaagtaccgcgcgtctgtagaaagcagatcacatctacaaagagatgattacaagacgaaactctaacttttatctagacaaaatgaaaccagccctaggaacgaacccgacgaaccgacgggcccttacgttatttattcggtagtactaacgtaacgaccttaggaactaacgaaacggtacggggtacggtacccgttagggtttacttccgggg

SEQ ID NO: 426368 - DNA, 586 bp, Homo sapiens
  misc_feature: GZ8MTXP02H1E1Z.3.17.B06.1.454.CMB.2.raw
  modified_base (308)..(308): a, c, t, g, unknown or other
  modified_base (475)..(475): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtcccctaagactctcctgtgcagcctctggacctcacccttcacgctcaatggcccactacgtggactggggtcccnccaggcctccgaggggaagggctgggagtggggttggccgttctagagacaacaactaacagtcgaccaccgacaacaataccgccgcgtctgtagaaaggcaagacttccaccatctacaagagatagattcaagagactctaactttatctagacaaatgaaacngacctagaacgaaccgacgaccgacggccgttatactttattgtacgtactagtaacgtaccgtaggaactaacgaaacggacgggttacggtaaccgttggttactcggg

SEQ ID NO: 426369 - DNA, 583 bp, Homo sapiens
  misc_feature: GZ8MTXP02G1H6H.3.17.B06.1.454.CMB.2.raw
  modified_base (260)..(260): a, c, t, g, unknown or other
  modified_base (391)..(391): a, c, t, g, unknown or other
  modified_base (402)..(402): a, c, t, g, unknown or other
  modified_base (471)..(471): a, c, t, g, unknown or other
  modified_base (490)..(490): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctntggactcaccttcacgctacaatggcccactacgtggactcggggtccgccaggcctccgaaggggaacggggctgggaggttggggttcggccgtttcgaggagaccacaactacagtgacaccgctaanaactccgccgngtctgtagaaacgcagattcgaccatcctacaagacgattgacttcgaagacgaaacttcaacttttanctagaacaaagtcgaaacngcctaagaaccgaaccgacgaccgaccggtcctacttagttacgttgtactaacgtaacgtacggtactaaggtactaaccggaacggtacgg

SEQ ID NO: 426370 - DNA, 583 bp, Homo sapiens
  misc_feature: GZ8MTXP02F97A5.3.17.B06.1.454.CMB.2.raw
  modified_base (369)..(369): a, c, t, g, unknown or other
  modified_base (461)..(461): a, c, t, g, unknown or other
  modified_base (465)..(465): a, c, t, g, unknown or other
  modified_base (492)..(492): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggacgggtccctaagactctcctgtgcagcctctggactcaccttcacgctcaatggccactacgtggactgggtccgccaggctccgaggggaaggggctgggaggtggggttcggccgtttcgtagagacaacaactaaacngtcgaccaccgcaacaataccgccgcgtctggtagaaaggcaagacttcaccatccacaaagagatgattacaagagaaactctaactttanctanacaaatgaacagcctagacgaaaccgngaccacgggcctactatttagtgtgtacaagtacgaccgttaaggaacttaacgaaacggtcgggtacgtaccgtcgggttaattccgggg

SEQ ID NO: 426371 - DNA, 592 bp, Homo sapiens
  misc_feature: GZ8MTXP02GW4RA.3.17.B06.1.454.CMB.2.raw
  modified_base (306)..(306): a, c, t, g, unknown or other
  modified_base (341)..(341): a, c, t, g, unknown or other
  modified_base (344)..(344): a, c, t, g, unknown or other
  modified_base (355)..(355): a, c, t, g, unknown or other
  modified_base (442)..(442): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagctctcctgtgcagcctctggactcaccttcacgctcaatcggccactacgtggactgggtcccncaggctccgagggagggctggagtgggtgccgttnagngacacaactanagtgacaccgcacaatacgccgcgtctgtgaaaggcagattcaccatctacaagagatgacttacgaagacgtaactctaactttancgtagacctaaaatcgaaacacgaccctaggaaacgaaaaccccggtacgaccgaccggggtacccttactaacgttttacttggttacgtaccaagttaacggaacccgttagggaacttaaccggaaaccgggtacgggtttaccggg

SEQ ID NO: 426372 - DNA, 418 bp, Homo sapiens
  misc_feature: GZ8MTXP02HHBQC.3.17.B06.1.454.CMB.2.raw
  modified_base (273)..(273): a, c, t, g, unknown or other
  modified_base (306)..(306): a, c, t, g, unknown or other
  modified_base (311)..(311): a, c, t, g, unknown or other
  modified_base (335)..(335): a, c, t, g, unknown or other
  modified_base (339)..(339): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (366)..(366): a, c, t, g, unknown or other
  modified_base (382)..(382): a, c, t, g, unknown or other
  modified_base (406)..(406): a, c, t, g, unknown or other
  modified_base (410)..(410): a, c, t, g, unknown or other
  modified_base (414)..(414): a, c, t, g, unknown or other
  modified_base (418)..(418): a, c, t, g, unknown or other
tcagagacgcactccacgaccggtgctcgatttagtcgatagtgaaggggagctctgagagcggagccccagccccagaattcccaggtgtttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaaagactctcctgtgcagcctctggactcaccttnacgctcaatggccactacgtggactgggtcccncagcncgagggaggctggagtggtgcctnaganacacaacangtnacacgnacaaatacncgcgtctgtagaaganagatacacatctacaacccccganatanatanagan

SEQ ID NO: 426373 - DNA, 577 bp, Homo sapiens
  misc_feature: GZ8MTXP02I5E9T.3.17.B06.1.454.CMB.2.raw
  modified_base (299)..(299): a, c, t, g, unknown or other
  modified_base (369)..(369): a, c, t, g, unknown or other
  modified_base (440)..(440): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagctctcctgtgcagcctctggactcaccttcacgctcaatggccatacgtggactggggtccnccaggctccgaggggaagggctggagtggggttgccgtttcagagacacaactaacagtccgacacccgnaacaataccgccgcgtctgtgaaaagcagattcaccatcctacaagagatgattcaagagactcactttanctgacaaatgaaacngcctagacgaaacccgcgaacaccgggacctacttaattaagttggtactacaacttaacggaccctaaggaacttaaaccgaacggtacggtaggtaacccgtgggtaactttcccggggg

SEQ ID NO: 426374 - DNA, 536 bp, Homo sapiens
  misc_feature: GZ8MTXP02HSZXQ.3.17.B06.1.454.CMB.2.raw
  modified_base (336)..(336): a, c, t, g, unknown or other
  modified_base (384)..(384): a, c, t, g, unknown or other
  modified_base (434)..(434): a, c, t, g, unknown or other
tcagagacgcactccacgaccggtgctcgatttagtcgatagtgaaggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagactctcctgtgcagcctctggactcaccttcacgctcaatggccactacgtggactgggtccgcaggctccgaggggagggctggagtgggtggccgtttntagagacacaactaacagtgacaccgcacaataccgcgcgtctggtanaaaggcagacttcaccatctacaagagatgattcagagaactcaatttancttagacaaatgaaacagcctagaacgaaccgacgacgacgccgtctatttatgtgtcatacgacctagaatacaacgtacggtgtacctaggtacgttcgg

SEQ ID NO: 426375 - DNA, 581 bp, Homo sapiens
  misc_feature: GZ8MTXP02JCW2H.3.17.B06.1.454.CMB.2.raw
  modified_base (323)..(323): a, c, t, g, unknown or other
  modified_base (371)..(371): a, c, t, g, unknown or other
  modified_base (385)..(385): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttcgtgtaggtatttacaagtgtcagtgtgaggtgcaccgtggtggagtcgtgggtggaggcttggtccagcctggagggtccctaagactctctgtgcagcctctggactcaccttcacgctcaatggccactacgtgactggtcgccagctccgaggaagggcgtggnggtgggttggcgttctagagaccacaactaacagtgacaccgcacaanaacgccgcgtctgngaaagacgaagactacacactactacaagagagtagtatacaagaacgtaactacttacttactactacgtaactaaataacgaacgacgtacgacgaacgaaccgaaccgaaccgaccggtaccgttacttacttacgttacgttacgtaacgtaacgtaacgtaacgtaacgtaacgtaacgtaacggtaacgg

SEQ ID NO: 426376 - DNA, 534 bp, Homo sapiens
  misc_feature: GZ8MTXP02IR776.3.17.B06.1.454.CMB.2.raw
  modified_base (305)..(305): a, c, t, g, unknown or other
  modified_base (342)..(342): a, c, t, g, unknown or other
  modified_base (429)..(429): a, c, t, g, unknown or other
  modified_base (441)..(441): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagactctcctgtgcagcctctggactcaccttcacgctcaatggccactacgtggactgggtccncaggctccgaggggagggctggagtgggttgccgttntagagacaccaactacagtgacaccgcacaatacgccgcgtctagtagaaaggcagtattcaccatctacaagagatgatcaagganaactctatttanctagacaaaatgaacagcctagaacgaacccgacgacacgggccttatattacttgtgtacaagttacgactaggatacgaacggacgttacg

SEQ ID NO: 426377 - DNA, 544 bp, Homo sapiens
  misc_feature: GZ8MTXP02JNZC0.3.17.B06.1.454.CMB.2.raw
  modified_base (260)..(260): a, c, t, g, unknown or other
  modified_base (348)..(348): a, c, t, g, unknown or other
  modified_base (389)..(389): a, c, t, g, unknown or other
  modified_base (514)..(514): a, c, t, g, unknown or other
tcagagacgcactccacgaccggtgctcgatttagtcgatagtgaaggggagctctgagagcggagccccagcctcagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagactctcctgtgcagcctntggactcaccttcacgctcaatcggccactacggtggactgggtcccgcaggctccgaggggagggctgggaggtgggttggccgttnaggagaccacaactacagtgaccacgcaacaataccgccgngtctgtagaaaggcagactcacatctacaagagatagactttacagaacgacttacactttatacctgaccaaatgaaacagcctagaacgaaccgacgacaccggcgttactagttacttggtntcatacggacctaggactacgaacgtacgg

SEQ ID NO: 426378 - DNA, 552 bp, Homo sapiens
  misc_feature: GZ8MTXP02GJ3ME.3.17.B06.1.454.CMB.2.raw
  modified_base (306)..(306): a, c, t, g, unknown or other
  modified_base (341)..(341): a, c, t, g, unknown or other
  modified_base (361)..(361): a, c, t, g, unknown or other
  modified_base (368)..(368): a, c, t, g, unknown or other
  modified_base (502)..(502): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagctctcctgtgcagcctctggactcaccttcacgctcaatcggccactacggtgactgggtccncaggctccgagggagggctggagtgggtgccgttnagagacaccaactaacagtnacaccgnacaataccgccgcgtctaggtagaaacggcaagtacttcaaccatctacaagtagatgattcaaagagaaactctaactttatctagacaaatgaacagcctagacgaacccgacgacacggcctacttaattntcgtgtacaagtaacgtaccgtaaggactaaccgaaacggtacggtacgg

SEQ ID NO: 426379 - DNA, 562 bp, Homo sapiens
  misc_feature: GZ8MTXP02I4HF1.3.17.B06.1.454.CMB.2.raw
  modified_base (293)..(293): a, c, t, g, unknown or other
  modified_base (334)..(334): a, c, t, g, unknown or other
  modified_base (338)..(338): a, c, t, g, unknown or other
  modified_base (351)..(351): a, c, t, g, unknown or other
  modified_base (362)..(362): a, c, t, g, unknown or other
  modified_base (409)..(409): a, c, t, g, unknown or other
  modified_base (414)..(414): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtggtttctgtagttatttacaaggtgtcagtgtgaggtgcactggtggagtcgtgggggagcttggtccagcctgggaggtccctaagctctcctgtgcagcctctggactcaccttcacgctcaatggccactacgtggactgggtccncaggctccgaggggaagggctgggagtgggttggccgtttntagngacacaactaacngtgaccaccgnaacgaataccgccgcgtctggtagaaaggcaagattcaccatcctanaaganatgatacagaatactctaacttatctagaacaaatacgaacacgccgtagaacgaaccgacgaccgacggtcctacttattagttcgtatactaagtacgacgtaagtaactaacgaacggtacggtagtaccgtaggttacgttcgg

SEQ ID NO: 426380 - DNA, 595 bp, Homo sapiens
  misc_feature: GZ8MTXP02IE14F.3.17.B06.1.454.CMB.2.raw
  modified_base (252)..(252): a, c, t, g, unknown or other
  modified_base (428)..(428): a, c, t, g, unknown or other
  modified_base (445)..(445): a, c, t, g, unknown or other
  modified_base (450)..(450): a, c, t, g, unknown or other
  modified_base (460)..(460): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttcttgttgttatttacaaggtgtccagtgtgaggtgcacctggtggagtctgggggagcttggtccagcctggagggtccctaagactctcctgtgcagcctntggactcaccttcacgctcaatcggccactacggtggacctggggtcccgccaggcctccgaggggaaggggctagggaggtggggttggccgtttctaggagacaacaactaaacagtcgaaccaccgcaacaataccgccgcgtctgtagaaaggcagacttcacctatcctanaagagatgacttcaganaactntaacttttanactagaacaaagtacgaaacacgaccgagaacgaaaccgacgacgtaccggtaccttacttattagttcgtcgtactaagtacgtaacgtaagaactaacggaacggtacggttagtaccgttaggttacgtcgg

SEQ ID NO: 426381 - DNA, 590 bp, Homo sapiens
  misc_feature: GZ8MTXP02G4XX8.3.17.B06.1.454.CMB.2.raw
  modified_base (471)..(471): a, c, t, g, unknown or other
  modified_base (489)..(489): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatggccactacggtggactcggggtccgccaggcctccgaggggaaggggctgggaggtggggttggccgtttcgtagagacaacgaaactaacagtcgacaccgcaacaacgtaccgccgcgtctcggtagaaaacggcaagacttccaacccattcctacaaagagatgattcgaagagaactctaatttanctagacaaatgaaaaccngaccagaacgaaccgacgacacggtaccttactattagtcgtcgtacacgtacgaaccgtaggaactaacgaacggtacggtacgtacgtaggtacgtcgg

SEQ ID NO: 426382 - DNA, 758 bp, Homo sapiens
  misc_feature: GZ8MTXP02H5CS3.3.17.B06.1.454.CMB.2.raw
  modified_base (274)..(274): a, c, t, g, unknown or other
  modified_base (574)..(574): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttcctgttgttattttacaaggtgtccagtgtgaggtgcacctggtggagtcgtgggggagcttggtccagcctgggaggtccctaagactctcctgtgcagcctctggacctcaccttnacgctcaagtggaccacgtacgtggaccttggggtcccgccgaggcctacccggaagggggaacggggccttaggggagggtttcgggggttcgggtcccgttttacgtaaggaacggaaccaaccccgaaaacgttaaaaccgaggtacgaacccaacccggcaacaaacgttaccggcccccggtcgttaccgtgggtaaacgaaaacgggcctaaggaactttcccaaaccctattaccctaacgaaaaggagtaataggtattaccgaagtaacgtaaacttacgttaacttttanacttagaacctaaaagttcgaaacaacggtaccctaggaaaaccggtaaaccccggacgaaaaccgtacccgggtacccgttaacgttaaactttacgttacggtacgttaacctaaacgttaacggaaacccgttaagggtaaacttaacccggaaaaccgggttacggggtttaaaccgggg

SEQ ID NO: 426383 - DNA, 596 bp, Homo sapiens
  misc_feature: GZ8MTXP02F77IG.3.17.B06.1.454.CMB.2.raw
  modified_base (368)..(368): a, c, t, g, unknown or other
  modified_base (392)..(392): a, c, t, g, unknown or other
  modified_base (451)..(451): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggaggcgttggtccagccgtgggacgggtccctaagactctcctgtgcagcctctggactcaccttcacgctcaatcggccactacgtggactgggtccgccaggctccgaggggaagggctgggaggtggggttggccgttgtagagacaacaactaacngtcgacaccgcaacaataccgtcncgtctgtagaaaggcaagacttcaaccatcacaaagagatgattacgaagagaaccttntaacttttanctagacaaatgaaacacgcctagaacgaaccgacgaaccacgggcttactaatttacttggtacttacaagttacgaacctaaggaactaaacgaaacggtccggggttagttaccctagggttactttcggggg

SEQ ID NO: 426384 - DNA, 564 bp, Homo sapiens
  misc_feature: GZ8MTXP02GDDLY.3.17.B06.1.454.CMB.2.raw
  modified_base (306)..(306): a, c, t, g, unknown or other
  modified_base (350)..(350): a, c, t, g, unknown or other
  modified_base (367)..(367): a, c, t, g, unknown or other
  modified_base (377)..(377): a, c, t, g, unknown or other
  modified_base (420)..(420): a, c, t, g, unknown or other
  modified_base (443)..(443): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctggagggtccctaagactctcctgtgcagcctctggactcaccttcacgctcaatggccactacgtggactggggtccnccaggcctccgaggggaaggggctgggagtggggttggccgttnagagacaccaactaacngtgacaccgnacaatcgccgcgtctgtagaaaggcagattcacatctacaagngatgattcagagaactcatttanctgacaaatgaactacgcctagaacgaaacccgacgaaccgaccgggacccgttataacgtttattcggtcgttaccaagttacgaaccgttaggaactaaccgaacggtacgggttacgg

SEQ ID NO: 426385 - DNA, 597 bp, Homo sapiens
  misc_feature: GZ8MTXP02GOPFA.3.17.B06.1.454.CMB.2.raw
  modified_base (300)..(300): a, c, t, g, unknown or other
  modified_base (339)..(339): a, c, t, g, unknown or other
  modified_base (449)..(449): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggagggtccctaagactctcctgtgcagcctctggactcacctcacgctcaatggccactacgtggactgggtccnccgaggctccgaggggagggctgggagtgggtgccgttnagagacacaactaacagtacgaccaccgcaacaataccgcgcgtctgtagaaaggcagacttcacctatactcaaagagatgacttcaagacgaactctaacttttaacnctagaactaaagtacgaaacacgccgtaaggaaaccggaaacccgacgaaccgacggtacccgttacttaacgtttagttcgtacgtactacgtaacgtaacgtagtaactaaccgaacggtacggtacgtacgtcggttacgtcggg

SEQ ID NO: 426386 - DNA, 726 bp, Homo sapiens
  misc_feature: GZ8MTXP02GMIF0.3.17.B06.1.454.CMB.2.raw
  modified_base (312)..(312): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacgtggtggagtcgtggggagcttggtccagccgtgggacgggtccctaagactctcctgtgcagcctcgtggacctcaccttcacgctcaatcggccacgtacggtggacgtcggggtcccnccgaggcctaccggagggggaacggggtctaggggaggttggggttacggtcccggtttacgaaggacgaaaccaaactaaactaaacgaggtaccgaacccaccgacaaacaacgtaccggcccgtcgtcgtaggtacggaaaacggcaagtactttcccaaacctattacccgagaaaggtagtaattaggtaactttacgaaaggtaacgtaaacccttcttaaacttttagtccgtaacgaaacctaaaagtaccgaaaccgtacgtaccgtaaggaaacccgaaaccccggacgaaccggtaccggtaccctttattacgtttagttacgtacgtaccaagttaaccggaaccgtaaaggaaccttaacggaacggttacgggttacgttacgttggttacgttcgggg

SEQ ID NO: 426387 - DNA, 557 bp, Homo sapiens
  misc_feature: GZ8MTXP02H5DVI.3.17.B06.1.454.CMB.2.raw
  modified_base (306)..(306): a, c, t, g, unknown or other
  modified_base (350)..(350): a, c, t, g, unknown or other
  modified_base (369)..(369): a, c, t, g, unknown or other
  modified_base (395)..(395): a, c, t, g, unknown or other
  modified_base (431)..(431): a, c, t, g, unknown or other
  modified_base (448)..(448): a, c, t, g, unknown or other
  modified_base (457)..(457): a, c, t, g, unknown or other
  modified_base (503)..(503): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcacccttcacgctcaatcggccactacgtggactggggtcccnccaggctccgaggggaagggctgggaggtggggttggccgtttntaggagacacaaactaaangtcgacaccgcaacaataccgcccgngtctggtagaaaggcagattccaccatctacaaagngatgattcaagagactnaacttttanctgacaaaatgaaacagcctagaacgaaaccgacgacacggccgtntatttatgtgtacatacgactaggaactacgaacgcggtgtacctggtactcgg

SEQ ID NO: 426388 - DNA, 557 bp, Homo sapiens
  misc_feature: GZ8MTXP02GT126.3.17.B06.1.454.CMB.2.raw
  modified_base (306)..(306): a, c, t, g, unknown or other
  modified_base (429)..(429): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggtccnccaggcctccgaggggaaggggctgggagttggggttggccgtttcgaggagacaccaactaacagtagaccaccgcacaaataccgccgcgtctgtagaaaggcagatcacatctacaaganatgattcaagagtaaactctaactttatctagactaaaatgaaacacgcctagaacgaacccgacgacgacggtcctatattactcgtagtcaagtacgaacctaggactacgaacggtcggttacgg

SEQ ID NO: 426389 - DNA, 663 bp, Homo sapiens
  misc_feature: GZ8MTXP02HS4VC.3.17.B06.1.454.CMB.2.raw
  modified_base (305)..(305): a, c, t, g, unknown or other
  modified_base (341)..(341): a, c, t, g, unknown or other
  modified_base (352)..(352): a, c, t, g, unknown or other
  modified_base (363)..(363): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcttgggttttccttgttgttattttacaaggtgtccagtgtgaggtgcacctgggtggagtcgtgggggaggcttggtccagccgtgggagggtccctaagactctcctgtgcagcctctggactcaccttcacgctcaatcggccactacgtggactgggccncaggctcgaggggaggctggagtggttgcttgaganacacaataacngtcgacaccgnaacaatacgccgcgtctgtagaaaaggcaagtaacttccaacctatcctacaagacgatgaattcaaaggactaaacttctaaactttttanactagtaaactaaagtacgaaacacgtaccgtaagaaacccggaaacccgaaccgaaccgacccgggtaacctttaacgttaagttttacgttacgttacgttaaacctaacgttaaacgtaaacccgttaaagggtaaaccgttaaaacccggaaaaccgggttaccggggttaacggtttacccggttaggggtttaccgtcgggg

SEQ ID NO: 426390 - DNA, 557 bp, Homo sapiens
  misc_feature: GZ8MTXP02FY9MY.3.17.B06.1.454.CMB.2.raw
  modified_base (373)..(373): a, c, t, g, unknown or other
  modified_base (448)..(448): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctgggagggtccctaagactctcctgtgcagcctctggactcaccttcacgctcaatggccactacgtggactgggtccgccaggcctccaggggaaggggctgggagtggggttggccgttctaggagacacaactaacagtcgacaccgnaacaataccgccgcgtctgtagaaagcagattcaccatctacaagagatgattcaagtagaaactctactttaanctagacaaaattagaaacagaccctagaacgaaaccgacgacgacggccgtactattatgtgtacatacgacctaggaatacgaacgacggtgtacctggtacgttcgg

SEQ ID NO: 426391 - DNA, 563 bp, Homo sapiens
  misc_feature: GZ8MTXP02HC83Z.3.17.B06.1.454.CMB.2.raw
  modified_base (307)..(307): a, c, t, g, unknown or other
  modified_base (422)..(422): a, c, t, g, unknown or other
  modified_base (449)..(449): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcacctggtggagtcgtgggggaggcttggtccagcctgggacgggtccctaagctctcctgtgcagcctctggactcaccttcacgctcaatggccactacgtggactgggtccncaggctccgaggggagggctggaggtgggtgccgttgagagacaccaactaacagtcgacaccgcacaataccgccgtcgtctaggagaaaggcagattccaccatctacaaganatgattcaagaactaactctaatttancagacaaatgaacacgcctagaacgaccgaacgacgaccggtcccgttattaatttacgttcgtagtacctaagttacgacccttaaggactaaacgaacggtcggtttaacgg

SEQ ID NO: 426392 - DNA, 557 bp, Homo sapiens
  misc_feature: GZ8MTXP02IY7A4.3.17.B06.1.454.CMB.2.raw
  modified_base (257)..(257): a, c, t, g, unknown or other
  modified_base (304)..(304): a, c, t, g, unknown or other
  modified_base (339)..(339): a, c, t, g, unknown or other
  modified_base (355)..(355): a, c, t, g, unknown or other
  modified_base (402)..(402): a, c, t, g, unknown or other
  modified_base (407)..(407): a, c, t, g, unknown or other
  modified_base (425)..(425): a, c, t, g, unknown or other
  modified_base (434)..(434): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttatttacaaggtgtccagtgtgaggtgcacctgggtggagtcgtgggggaggcttggtccagcctgggagggtccctaagactctcctgtgcagcctntggactcaccttcacgctcaatcggaccactacgtggactgggcccncaggctccgaggggaggctggagtgggtgccgttnagagacacaactaacngtcaccacgcacaataccgcgcgtctgagaaagcaagatcacatcanaaganatgtactcagaagaactntaaactttnctagacaaaatgaaactcgcctaggaacgaaccgacgaacgacggcttactatttagtcgtagtacagtacgaccgttaaggaactaaacgacggtacggtacgtaccttaggtacgttcggg

SEQ ID NO: 426393 - DNA, 568 bp, Homo sapiens
  misc_feature: GZ8MTXP02FVI1R.3.17.B06.1.454.CMB.2.raw
  modified_base (296)..(296): a, c, t, g, unknown or other
  modified_base (355)..(355): a, c, t, g, unknown or other
  modified_base (435)..(435): a, c, t, g, unknown or other
  modified_base (451)..(451): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtggtttctgttgttatttacaaggtgtcagtgtgaggtgcacctgggtggagtcgtgggggagcttggtccagcctggagggtccctaagactctcctgtgcagcctctggactcaccttcacgctcaatggccactacggtgactgggtccnccaggcctccgaggggaagggctggagtggggtcggcgttctagagacacgaataaacngtgaccaccgcaacaataccgccgcgtctgtagaaaacggcaaggtacttcaaccatctacaaagagatgattcaagganaaactctaactttacnctagacaaattgaaacagcctagacgaaacgcgaacacgggctactattatcgtgttacagttaacgcctttaaggaacttacgaaacgtacggtagtaaccgtggttacttccggg

SEQ ID NO: 426394 - DNA, 462 bp, Homo sapiens
  misc_feature: GZ8MTXP02JMNCH.3.17.B06.1.454.CMB.2.raw
  modified_base (457)..(462): a, c, t, g, unknown or other
tcagagacgcactccacgaccggtgctcgatttagtcgatagtgaaggggctggagtgggttggccgttctagagacacaactaacagtgacaccgcacaatacgccgcgtctgtgaaaggcagattcaccatctcaagagatgattcagagaactcactttatctgcaaatgaacagcctgagaaccgacgacacggccgtctattattgtgtcatagacctaggatacaacgacggtggtacctggtattcgcggtggtctacgtggggccagggaaccctggtcaccgtctcctcagcctccaccaacgggccccatccggtccttcccccgtggcccgcccctgcctccgaggacgccaccccctccgagacgcacaggccggccctggggctgcctggtcaaggcctacgttccgagtcgcgtctcgtgacgcgggctggcaaggcgcatgnnnnnn

SEQ ID NO: 426395 - DNA, 604 bp, Homo sapiens
  misc_feature: GZ8MTXP02JQXE7.3.17.B06.1.454.CMB.2.raw
  modified_base (310)..(310): a, c, t, g, unknown or other
  modified_base (354)..(354): a, c, t, g, unknown or other
  modified_base (477)..(477): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggaggcttggtccagcctgggagggtccctaagactctcctgtgcagcctctggactcaccttcacgctcaatcggccactacgtggactggggtccnccgaggcctccgaggggaggggctgggagtggggttggccgttntaggagacacaaactaacagtgacaccgcacaataccgccgcgtctgtagaaaggcaagacttacaccatctacaagagatgattacgaagagaaactctatttatctagacaaatcgaaacncgacctagaacgaaaacccgacggaaccgaccgggtacccgttacttaacgtttagttacggtacgtactaagttaacggaacccttaaaggggaccttaaaccggaaacgggtacgggtttacggg

SEQ ID NO: 426396 - DNA, 588 bp, Homo sapiens
  misc_feature: GZ8MTXP02I1WB1.3.17.B06.1.454.CMB.2.raw
  modified_base (256)..(256): a, c, t, g, unknown or other
  modified_base (302)..(302): a, c, t, g, unknown or other
  modified_base (340)..(340): a, c, t, g, unknown or other
  modified_base (523)..(523): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggagcttggtccagcctggagggtccctaagactctcctgtgcagcctntggactcaccttcacgctcaatggccactacgtggactggggtccncaggctccgaggggaagggctgggagtgggtgccgttntagagacaacaaactaaacagtcgaaccaccgcaaacaataccgccgcgtctaggtagaaaaggcaagaacttccaacctatctacaaagagatgattacgagaagaactctaactttatctagacaaaatgaaaacagcctagaacgaaaccgacgaacgacggccctactaattatcggtnttacaattacgaaccttaaggaactaacgaaaacggtacggtagtacccttagggtacttcgggg

SEQ ID NO: 426397 - DNA, 530 bp, Homo sapiens
  misc_feature: GZ8MTXP02JGCIE.3.17.B06.1.454.CMB.2.raw
  modified_base (306)..(306): a, c, t, g, unknown or other
  modified_base (341)..(341): a, c, t, g, unknown or other
  modified_base (361)..(361): a, c, t, g, unknown or other
  modified_base (428)..(428): a, c, t, g, unknown or other
  modified_base (440)..(440): a, c, t, g, unknown or other
  modified_base (444)..(444): a, c, t, g, unknown or other
  modified_base (455)..(455): a, c, t, g, unknown or other
  modified_base (486)..(486): a, c, t, g, unknown or other
  modified_base (497)..(497): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggagggtccctaagactctcctgtgcagcctctggactcaccttcacgctcaatggccactacgtggactgggtccncaggctcgaggggagggctggagtgggtgccgttnagagacaccaactaacagtnacaccgcacaatacgccgcgtctgtagaaaggcagtattccaccatctacaagagatgattcaaganaactctatttanctanacaaatgaacnggcctagacgaaccgacgacgacggaccgtntacttatcgtntacaagtagacctaggactacgaacgacggtcg

SEQ ID NO: 426398 - DNA, 686 bp, Homo sapiens
  misc_feature: GZ8MTXP02IOOQ9.3.17.B06.1.454.CMB.2.raw
  modified_base (367)..(367): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctggaggtccctaagctctctgtgcagcctctggactcaccttcacgctcaatggccactacggtggactcggggtcccgccgaggcctccgaggggaaggggctgggaggtggggttggccgtttcgtagagacacaactaacgngtcgaccaccgcaacaagtaccgccgcgtctgtagaaaagggcaagtattccacatcgtacaaagagtatagattacaggaacgaactctaaacttttagtcctagtaacctaaaagttcggaaaacctcggacccttaaggaaaccggaaaaccccggaacgtaacccgaaccgggggtaccccctttatttaaacgttttaagtttggtttacgaaccctaagttaaccggtaacccgtttaaaggaaacgttaacccggaaaacgggttacggggttaacggttaacccgtttaggggttaaacgtttcccggggg

SEQ ID NO: 426399 - DNA, 619 bp, Homo sapiens
  misc_feature: GZ8MTXP02HB8FY.3.17.B06.1.454.CMB.2.raw
  modified_base (301)..(301): a, c, t, g, unknown or other
  modified_base (450)..(450): a, c, t, g, unknown or other
  modified_base (506)..(506): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggaggcttggtccagcctggagggtccctaagactctcctgtgcagcctctggactcaccttcacgctcaatggcccactacgtggactgggtccnccaggcctccgaggggagggctggagtgggttggccgtttctaggagacaacgaaactaacgagtcgaccaccgtcaacaagtaccggcccgtcggtcctaggtacgaaaagggccaaggaactttccaaccctatcctacaaaagganatgtattacgaagaacgtaaacctcttaaactttactctagaactaaaatgaaacncgacctaggaacgaaacccgacgtaaccgacggtccgtactaattagtcgtacgactagtaacgacgtaaggaactaaccgaacggtacggttacgtaccgttggtacgtcgg

SEQ ID NO: 426400 - DNA, 610 bp, Homo sapiens
  misc_feature: GZ8MTXP02FU6TJ.3.17.B06.1.454.CMB.2.raw
  modified_base (303)..(303): a, c, t, g, unknown or other
  modified_base (343)..(343): a, c, t, g, unknown or other
  modified_base (461)..(461): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtggggggaggcttggtccagcctggagggtccctaagactctcctgtgcagcctctggactcaccttcacgctcaatggccactacgtggactgggtcccnccaggctccgaggggaagggctggagtggggtggccgttntaggagacacaaactaacagtcgaccaccgcaacaagtaccgccgcgtctggtagaaaacggcaagattcaaccatcctacaaagagattagattcaagacgaaactctaaactttanctagacaaaatgaaaacacgtcctaggaacgaaaccgacgaacgtaaccgggccctacttaagtttattcggtattacaattaacgaccttaagggaacttaaaccgaaacggtacgggttacggtaaccttgggttaactttccgggg

SEQ ID NO: 426401 - DNA, 599 bp, Homo sapiens
  misc_feature: GZ8MTXP02H17C2.3.17.B06.1.454.CMB.2.raw
  modified_base (256)..(256): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcactggtggagtcgtgggggaggcttggtccagcctgggagggtccctaagactctcctgtgcagcctntggactcaccttcacgctcaatcggccactacggtggactggggtcccgccaggcctccgaggggaacggggctggggagtggggttggccgtttactaggagacaacaactaaacagtacgaccaccgcaacaataccggcccgcgtctggtacgaaaggcaagacttcacctatctacaaagagatgaattcgaagaacgtactctaactttatcctagtacaaaatcgaaacacgcctagaacgaaccgagaccgacggacctactatttagtgtacgtacagtacgaaccgtaaggaactaacgaaacgtacgggttacgtaccgtaggttacgtccgg

SEQ ID NO: 426402 - DNA, 545 bp, Homo sapiens
  misc_feature: GZ8MTXP02FU3OF.3.17.B06.1.454.CMB.2.raw
  modified_base (440)..(440): a, c, t, g, unknown or other
  modified_base (534)..(534): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctctggactcaccttcacgctcaatggccactacgtggactgggtccgcaggctccgaggggaagggctgggagtgggttggccgttcagagacacaaactaacagtgaccaccgcacaatacgccgcgtctgtagaaagcagattcaccatctacaagagatgattcaagagaaactctactttanctagacaaaatgaaacagcctagacgaaccgagaccgacggcgtactagttatgtgtcatacgacttaggaactaacaacgtacggtagtaccnggtacttcggg

SEQ ID NO: 426403 - DNA, 588 bp, Homo sapiens
  misc_feature: GZ8MTXP02G49P2.3.17.B06.1.454.CMB.2.raw
  modified_base (252)..(252): a, c, t, g, unknown or other
  modified_base (301)..(301): a, c, t, g, unknown or other
  modified_base (342)..(342): a, c, t, g, unknown or other
  modified_base (360)..(360): a, c, t, g, unknown or other
  modified_base (426)..(426): a, c, t, g, unknown or other
  modified_base (441)..(441): a, c, t, g, unknown or other
  modified_base (446)..(446): a, c, t, g, unknown or other
  modified_base (454)..(454): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagcgtgggttttctgttgttatttacaaggtgtccagtgtgaggtgcacctggtggagtcgtggggaggcttggtccagcctgggaggtccctaagctctcctgtgcagcctntggactcaccttcacgctacaatcggccatacggtggactggggtcccncaggctccgaggggaagggctggggagtggggttgccgttntagagacaacaactaacngtcgaaccaccgacacgaaagtaccgccgcgtctaggtagaaaaggcaagacttccaaccatccanaagagatgatcaganaactntactttanctagacaaatcgaaaactgcctagagaaccgacgacacgggcctactagttattggtactactagtaacgtaccgttaaggaactaaacccgaaaggtaccgggtacgttaacccgttggttaactttccgggg

SEQ ID NO: 426404 - DNA, 596 bp, Homo sapiens
  misc_feature: GZ8MTXP02FOQ3U.3.17.B06.1.454.CMB.2.raw
  modified_base (305)..(305): a, c, t, g, unknown or other
  modified_base (342)..(342): a, c, t, g, unknown or other
  modified_base (439)..(439): a, c, t, g, unknown or other
  modified_base (455)..(455): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttgggtccagcctgggagggtccctaagactctcctgtgcagcctctggactcaccttcacgctcaatcggccactacgtggactgggcccncaggctccgaggggagggctggagtggggtgccgttnagagacaacaactaaacagtcgaaccaccgacaacaataccgccgcgtctggtagaaaagcaagattccacatctacaaagagatagattcaagganaaactctaaactttanctagactaaaagtcgaaacacgcctaggaacgaaacccgacgaaccgaccgggcctacttaatttattgtacgtacagttaacgaccgttaaggaacttaaacgaacggacgggttacgtacccgtaggtacgtttccggg

SEQ ID NO: 426405 - DNA, 617 bp, Homo sapiens
  misc_feature: GZ8MTXP02GVSCE.3.17.B06.1.454.CMB.2.raw
  modified_base (303)..(303): a, c, t, g, unknown or other
  modified_base (363)..(363): a, c, t, g, unknown or other
  modified_base (374)..(374): a, c, t, g, unknown or other
  modified_base (462)..(462): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctgggtggagtcgtgggggaggcttggtccagcctgggagggtccctaagactctcctgtgcagcctctggactcaccttcacgctcaatggccactacgtggactgggtccnccaggcctccgaggggagggctgggaggtgggttggccgttctagagacacaactaaacngtcgacaccgnaacaatacgccgcgtctgtagaaaggcaagtacttccaaccatctacaaagagattgaattcaagaacgtaaacttctaaacttttancttacgaactaaaactggaaaacaacggtccctaaggaacgaaacccggacgaaccgaccgggtcctacttaatttattggtactaccaattaacgaaccgttaggaactaaaccgaacggtacgggtcgttaaccgtgggtttaagtcccgggg

SEQ ID NO: 426406 - DNA, 539 bp, Homo sapiens
  misc_feature: GZ8MTXP02IXMK8.3.17.B06.1.454.CMB.2.raw
  modified_base (309)..(309): a, c, t, g, unknown or other
  modified_base (346)..(346): a, c, t, g, unknown or other
  modified_base (350)..(350): a, c, t, g, unknown or other
  modified_base (361)..(361): a, c, t, g, unknown or other
  modified_base (417)..(417): a, c, t, g, unknown or other
  modified_base (421)..(421): a, c, t, g, unknown or other
  modified_base (444)..(444): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtcgtgggggagcttggtccagcctgggagggtccctaagactctcctgtgcagcctctggactcaccttcacgctcaatcggccactacgtggactgggtcccncaggcctccgaggggagggctggagtgggtgccgttnaganacacaactacngtgacaccgcacaataccgccgcgtctgtagaaacgcagacttccacctatcctanaagnatgattcagagaactctatttanctagacaaatcgaacagacctagaacgaacccgacgacgacggccttactatttctgtcgtacaagttacgacgtagactacgacgtacgttacg

SEQ ID NO: 426407 - DNA, 570 bp, Homo sapiens
  misc_feature: GZ8MTXP02FOXHW.3.17.B06.1.454.CMB.2.raw
  modified_base (302)..(302): a, c, t, g, unknown or other
  modified_base (375)..(375): a, c, t, g, unknown or other
  modified_base (407)..(407): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttctgttagttatttacaaggtgtcagtgtgaggtgcacctggtggagtcgtgggggagcttggtccagcctggagggtccctaagactctcctgtgcagcctctggactcaccttcacgctcaatggccactacgtggactgggtccnccaggctcgagggagggctggagtggtggccttcagagacacaactacagtcgacaccgcacaataccgccgngtctgagaaagcagatcaacatcctacaaganatgatcgaaagactaaactcttaatttatactagaacaaatacgaacgaacgacgtacgaaacgaaaccgaacgaaccgaccgtaccgtacttaacgttacgttacgttacgtactaacgtaacgtaacgtaacgtaacgtaacgtaaacggtaacggtacgg

SEQ ID NO: 426408 - DNA, 594 bp, Homo sapiens
  misc_feature: GZ8MTXP02J4C5W.3.17.B06.1.454.CMB.2.raw
  modified_base (349)..(349): a, c, t, g, unknown or other
  modified_base (367)..(367): a, c, t, g, unknown or other
  modified_base (395)..(395): a, c, t, g, unknown or other
  modified_base (440)..(440): a, c, t, g, unknown or other
  modified_base (474)..(474): a, c, t, g, unknown or other
  modified_base (479)..(479): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagctgggttttccttgttgttatttacaaggtgtccagtgtgaggtgcacctgggtggagtcgtgggggagcttggtccagcctggaggtccctaagctctcctgtgcagcctctggactcaccttcacgctcaatggccactacgtggactgggtcccgccgaggctaccgaggggaggggctgggagttggggttgccgttnagagacaaccaactaacngtcgacacccgtcacaaatccggcccgngtctgtaggaaaagggcaagtacttccaaccatcgtacaaagganaatgattcgagaaataaccttctaacctttttanactanacaaacagaacgacgacgtacgaacgaaccgacgacgaccggtaccgtacttacttacttacgttacgtactaacgtacgtacgtacgtaacgtaacgtaacggtacgggtacgg

SEQ ID NO: 426409 - DNA, 648 bp, Homo sapiens
  misc_feature: GZ8MTXP02JUNA6.3.17.B06.1.454.CMB.2.raw
  modified_base (342)..(342): a, c, t, g, unknown or other
tcagagacgcactccacgaccggtgctcgatttagtcgatagtgaagggggagagcggagccccagccccagaattcccaggtgttttcatttggtgatcagcactgaacacagaggactcaccatggagtttgggctgagctgggttttccttgttgttattttacaaggtgtccagtgtgaggtgcacctggtggagtctgggggagcttggtccagcctgggagggtccctaagactctcctgtgcagcctctggactcaccttcacgctcaatcggccactacgtggactgggtcccgccaggctccgaggggagggctgggagtgggttggccgttntaggagacaacaactaacgagtcgacaccgacaacaataccgccgtcgtctggtagaaaggcaagtacttccaaccctattcctacaaagagattacgaattcgaaagtaacgtaaacttctaaactttatcctagaacctaaaatcggaaacacgacctaggaaacggaaacccgacgaaccgtaccggggaccctttacttaacgtttagttcgtacgtacctaagtaaccgtaaccgtaagggtaaactaaccgaaaacgggtacgggttacggtaaccctttagggggtaactttccggggg

SEQ ID NO: 426410 - DNA, 598 bp, Homo sapiens
  misc_feature: GZ8MTXP02IHAUZ.3.17.B06.1.454.CMB.2.raw
  modified_base (304)..(304): a, c, t, g, unknown or other
  modified_base (340)..(340): a, c, t, g, unknown or other
  modified_base (356)..(356): a, c, t, g, unknown or other
  modified_base (412)..(412): a, c, t, g, unknown or other
tcagagacgcactccacgaccggtgctcgatttagtcgatagtgaaggggagctctgagagcggagccccagccccagaattcccaggtgttttcatttggtgatcagcactgaacacagaggactcaccatggagtttgggctgagcgtggtttctgttagttatttacaaggtgtcagtgtgaggtgcacctggtggagtcgtgggggagcttggtccagcctggaggtccctaagactctcctgtgcagcctctgaactctaccttcacgctcaatcggccactacgtggacgtgggcccncaggctccgaggggagggctggagtgggtgccgttnagagacacaaactacngtcgacaccgcacaatacgccgcgtctgtagaaaggcagattacacctatcctaanaaagagtatagtactacgaagtaactaacttacttaactttacgtactagaactaaataacgtaacgtaacgacgtacgaacgaaaccgaaccgaccgaccggtaccgttacgttaacgtttacgttacgttacgtacgtaacgtaacgtaacgtaacgtaacgtaacgtaacggtaacggtacgg
